US012433943B2

United States Patent
Kanekiyo et al.

(10) Patent No.: US 12,433,943 B2
(45) Date of Patent: Oct. 7, 2025

(54) NANOPARTICLE-BASED INFLUENZA VIRUS VACCINES AND USES THEREOF

(71) Applicants: The USA, as represented by the Secretary, Department of Health and Human Services, Bethesda, MD (US); Unversity of Washington, Seattle, WA (US)

(72) Inventors: Masaru Kanekiyo, Bethesda, MD (US); Barney S. Graham, Rockville, MD (US); Seyhan Boyoglu-Barnum, Rockville, MD (US); Rebecca A. Gillespie, Bethesda, MD (US); Neil P. King, Seattle, WA (US); Daniel Ellis, Seattle, WA (US); Jing Yang Wang, Seattle, WA (US); George Ueda, Seattle, WA (US); Jorge Fallas, Seattle, WA (US)

(73) Assignees: UNIVERSITY OF WASHINGTON, Seattle, WA (US); THE USA, AS REPRESENTED BY THE SECRETARY, DEPARTMENT OF HEALTH AND HUMAN SERVICES, Bethesda, MD (US)

( * ) Notice: Subject to any disclaimer, the term of this patent is extended or adjusted under 35 U.S.C. 154(b) by 1095 days.

(21) Appl. No.: 17/423,565

(22) PCT Filed: Feb. 7, 2020

(86) PCT No.: PCT/US2020/017216
§ 371 (c)(1),
(2) Date: Jul. 16, 2021

(87) PCT Pub. No.: WO2020/163719
PCT Pub. Date: Aug. 13, 2020

(65) Prior Publication Data
US 2022/0072120 A1    Mar. 10, 2022

Related U.S. Application Data

(60) Provisional application No. 62/803,218, filed on Feb. 8, 2019.

(51) Int. Cl.
*A61K 39/12* (2006.01)
*A61K 39/145* (2006.01)
*A61P 31/16* (2006.01)
*C12N 7/00* (2006.01)
*C12N 15/86* (2006.01)
*A61K 39/00* (2006.01)

(52) U.S. Cl.
CPC ............ *A61K 39/145* (2013.01); *A61P 31/16* (2018.01); *C12N 7/00* (2013.01); *A61K 2039/55555* (2013.01)

(58) Field of Classification Search
CPC .......... A61K 39/12; A61K 2039/55555; A61K 39/145; A61P 31/16; C07K 14/005
See application file for complete search history.

(56) References Cited

U.S. PATENT DOCUMENTS

| | | | |
|---|---|---|---|
| 2009/0297614 A1 | 12/2009 | Rademacher et al. | |
| 2018/0137234 A1* | 5/2018 | Baker | A61K 38/03 |

FOREIGN PATENT DOCUMENTS

| | | |
|---|---|---|
| WO | 2013/044203 | 3/2013 |
| WO | 2016/109792 | 7/2016 |
| WO | 2018/005558 | 1/2018 |

OTHER PUBLICATIONS

Deng, et al. (2018) "Double-layered protein nanoparticles induce broad protection against divergent influenza A viruses," Nature Communications, vol. 9 Article 359: 1-12.
Marcandalli, et al. (Mar. 2019) "Induction of Potent Neutralizing Antibody Responses by a Designed Protein Nanoparticle Vaccine for Respiratory Syncytial Virus," Cell, vol. 176(6): 1420-1431.e17.
Wang, et al., (2019) "Development of a universal influenza vaccine using hemagglutinin stem protein produced from Pichia pastoris," Virology, vol. 526: pp. 125-137.
Ueda, et al., "Tailored design of protein nanoparticle scaffolds for multivalent presentation of viral glycoprotein antigens," bioRxiv, Jan. 30, 2020 (Jan. 30, 2020), pp. 1-38.
Ueda, "Computational Design of Symmetric Protein Complexes with Implications for Vaccine and Biotherapeutic Development", Dissertation, University of Washington, 2018.
Kanekiyo, et al. (Jul. 2013) "Self-assembling influenza nanoparticle vaccines elicit broadly neutralizing H1N1 antibodies", Nature, vol. 499 (7456): 102-106.
Kanekiyo, et al., (Mar. 2019) "Mosaic nanoparticle display of diverse influenza virus hemagglutinins elicits broad B cell responses," Nature Immunology, vol. 20: 362-372.
Georgiev, et al., (Feb. 2018) "Two-Component Ferritin Nanoparticles for Multimerization of Diverse Trimeric Antigens," ACS Infect. Dis. 2018, 4, 788-796.
Ueda, "Computational Design of Symmetric Protein Complexes with Implications for Vaccine and Biotherapeutic Development", Dissertation, University of Washington, Feb. 22, 2019.

* cited by examiner

*Primary Examiner* — Barry A Chestnut
(74) *Attorney, Agent, or Firm* — MCDONNELL BOEHNEN HULBERT & BERGHOFF LLP

(57) ABSTRACT

Nanoparticles and vaccines containing these nanoparticles that elicit an immune response against hemagglutinin (HA) proteins from a broad range of influenza viruses are provided. The nanoparticles are made from self-assembling proteins, at least one of which is joined to an immunogenic portion of an influenza HA protein. This immunogenic portion is displayed on the nanoparticle surface, making the nanoparticles useful for vaccinating subjects against influenza virus.

30 Claims, 35 Drawing Sheets

Specification includes a Sequence Listing.

UV-Vis Spectroscopy

Negative-stain Transmission Electron Microscopy

Size-Exclusion Chromatography

SDS-PAGE

UV-Vis Spectroscopy

Negative-stain Transmission Electron Microscopy

NANOPARTICLE-BASED INFLUENZA VIRUS VACCINES AND USES THEREOF

CROSS REFERENCE

This application is a U.S. National Phase of International Application No. PCT/US2020/017216, filed Feb. 7, 2020, which claims priority to U.S. Provisional Application No. 62/803,218, filed Feb. 8, 2019, both of which are incorporated by reference herein in their entirety.

REFERENCE TO SEQUENCE LISTING

This application contains a Sequence Listing submitted as an electronic text file named "19-163-PCT_Sequence_Listing_ST25.txt", having a size in bytes of 864 kb, and created on Feb. 6, 2020. The information contained in this electronic file is hereby incorporated by reference in its entirety pursuant to 37 CFR § 1.52(e)(5).

BACKGROUND

Protective immune responses induced by vaccination against influenza viruses are primarily directed to the viral hemagglutinin (HA) protein, which is a glycoprotein on the surface of the virus responsible for interaction of the virus with host cell receptors. HA proteins on the virus surface are trimers of HA protein monomers that are enzymatically cleaved to yield amino-terminal HA1 and carboxy-terminal HA2 polypeptides. The globular head consists exclusively of the major portion of the HA1 polypeptide, whereas the stem that anchors the HA protein into the viral lipid membrane is comprised of HA2 and part of HA1. The globular head of the HA protein includes two domains: the receptor binding domain (RBD), an approximately 148-amino acid residue domain that includes the sialic acid-binding site, and the vestigial esterase domain, a smaller approximately 75-amino acid residue region just below the RBD. The globular head includes several antigenic sites that include immunodominant epitopes. Examples include the antigenic sites Sa, Sb, $Ca_1$, $Ca_2$, and Cb on HA subtype H1, and A, B, C, D, and E on H3 subtype HA (see, for example, Caton A J et al, 1982, Cell 31:417-27).

Antibodies against influenza often target variable antigenic sites in the globular head of HA, which surround a conserved sialic acid-binding site, and thus, neutralize only antigenically closely related viruses. The variability of the HA head is due to the constant antigenic drift of influenza viruses and is responsible for seasonal endemics of influenza. In contrast, the HA stem is highly conserved and experiences little antigenic drift. Unfortunately, unlike the immunodominant head, the conserved HA stem is generally immunologically subdominant. Furthermore, RNA segments of the viral genome can undergo reassortment (antigenic shift) in host species, creating new viruses with altered antigenicity that are capable of becoming pandemics [Salomon, R. et al. Cell 136, 402-10 (2009)]. Each year, influenza vaccines are updated to reflect the predicted HA and neuraminidase (NA) for upcoming circulating viruses.

Current vaccine strategies for influenza use either a chemically inactivated or a live attenuated influenza virus. Both vaccines are generally produced in embryonated eggs which present major manufacturing limitations due to the time-consuming process and limited production capacity. Another more critical limitation of current vaccines is their highly strain-specific efficacy. These challenges became glaringly obvious during emergence of the 2009 H1N1 pandemic.

SUMMARY

This disclosure provides novel nanoparticle-based vaccines composed of self-assembling proteins that display immunogenic hemagglutinin (HA) influenza proteins on their surfaces in a highly ordered array. Such nanoparticles provide influenza vaccines that are easily manufactured, potent, and that elicit antibodies that are broadly protective.

One aspect of this technology is a nanoparticle comprising a plurality of first assemblies, each first assembly comprising a plurality of identical first proteins, and a plurality of second assemblies, each second assembly comprising a plurality of second proteins. In these nanoparticles, the plurality of first assemblies non-covalently interact with the plurality of second assemblies to form the nanoparticle. In these nanoparticles, the at least one second assembly comprises at least one second protein joined to an immunogenic portion of an influenza hemagglutinin (HA) protein, thereby forming a fusion protein and the nanoparticle displays the immunogenic portion of an HA protein on its surface. Additionally, in these nanoparticles, the sequence of the first protein differs from the sequence of the second protein.

A related aspect of this technology is a fusion protein comprising, or consisting of, an amino acid sequence at least 80%, 85%, 90%, 91%, 95%, 96%, 97%, 98%, or 99% identical, or 100% identical to a sequence selected from the group consisting of SEQ ID NOS:89, 245, 247, 249, 251, 253, 255, and 257, joined to an immunogenic portion of an influenza virus HA protein. Specifically, such fusion protein may be a fusion protein comprising, or consisting of, an amino acid sequence at least 80%, 85%, 90%, 91%, 95%, 96%, 97%, 98%, or 99% identical, or 100% identical to a sequence selected from the group consisting of SEQ ID NOS:91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 259, 261, 263, and 265.

Another aspect of this technology are nucleic acid molecules that encode these fusion proteins, expression vectors comprising these nucleic acid molecules, and cells comprising the nucleic acid molecules and/or expression vectors.

Another aspect of this technology is a composition comprising the nanoparticles of this disclosure. For example, a composition comprising these nanoparticles may be formulated as a vaccine. Thus, this technology also encompasses methods of vaccinating a subject against influenza virus by administering to the subject a composition comprising one or more nanoparticles of this disclosure.

Another aspect of this technology is a method of detecting anti-influenza virus antibodies by contacting at least a portion of a sample being tested for the presence of anti-influenza antibodies with a nanoparticle of this disclosure, and detecting the presence of an antibody-nanoparticle complex. When the presence of an antibody-nanoparticle complex is detected, these results indicate the sample contains anti-influenza antibodies.

A related aspect of this technology is a method to identify a subject having anti-influenza virus antibodies, by contacting a sample from a subject being tested for anti-influenza antibodies with a nanoparticle of this disclosure and analyzing the contacted sample for the presence of an antibody-nanoparticle complex. When the presence of an antibody-nanoparticle complex is detected, these results indicate the subject has anti-influenza antibodies. A closely related aspect of this technology is a method to identify a subject that has been exposed to influenza virus by contacting at least a portion of a sample from a subject being tested for anti-influenza antibodies with a nanoparticle of this disclosure and analyzing the contacted sample for the presence or level of an antibody-nanoparticle complex. When the presence or level of antibody-nanoparticle complex is detected and/or measured, these results indicate the presence or level of recent anti-influenza antibodies. These results may be compared to the recent anti-influenza antibody level with a past anti-influenza antibody level. Based on the results of the comparison, an increase in the recent anti-influenza antibody level over the past anti-influenza antibody level indicates the subject has been exposed to influenza virus subsequent to determination of the past anti-influenza antibody level.

Another aspect of this technology is a method of measuring the response of a subject to an influenza vaccine by administering to the subject a vaccine for influenza virus and contacting at least a portion of a sample from the subject with a nanoparticle of this disclosure, and analyzing the contacted sample for the presence or level of an antibody-nanoparticle complex. When the presence or level of an antibody-nanoparticle complex is detected, an increase in the level of antibody in the sample over the pre-vaccination level of antibody in the subject indicates the vaccine induced an immune response in the subject.

Another aspect of this technology is a method of producing a nanoparticle of this disclosure by producing a first, synthetic protein that self-assembles into a first multimeric assembly, producing a second protein comprising a self-assembling protein that self-assembles into a second multimeric assembly, and contacting the first assembly with the second assembly, and incubating the mixture under conditions suitable for the formation of a nanoparticle.

A further aspect provides polypeptides comprising an amino acid sequence that is at least 80%, 85%, 90%, 91%, 95%, 96%, 97%, 98%, 99% or, or 100%/c identical to the full length of the amino acid sequence of any one of SEQ ID NOS: 43, 45, 47, 49, 51, 53, 55, 57, 59, 61, 63, 65, 67, 69, 71, 73, 75, 77, 79, 81, 83, 85, and 87, wherein the polypeptide is not identical to the full length of the amino acid sequence of SEQ ID NO:41. Additional aspects include nucleic acid molecules encoding the polypeptide, expression vectors comprising the nucleic acid molecule, cells comprising the nucleic acid and/or the expression vector, and nanoparticles comprising the first polypeptides.

This Summary is neither intended nor should it be construed as being representative of the full extent and scope of the present invention. Moreover, references made herein to "the present disclosure," or aspects thereof, should be understood to mean certain embodiments of the present disclosure and should not necessarily be construed as limiting all embodiments to a particular description. The present invention is set forth in various levels of detail in this Summary as well as in the attached drawings and the Detailed Description and no limitation as to the scope of the present disclosure is intended by either the inclusion or non-inclusion of elements, components, etc. in this Summary. Additional aspects of the present invention will become more readily apparent from the Detailed Description, particularly when taken together with the figures.

BRIEF DESCRIPTION OF FIGURES

FIG. 1A schematically depicts a non-limiting example of the unique assemblies that non-covalently interact to form exemplary nanoparticles of this disclosure, and in vitro assembly of a two-component nanoparticle co-displaying multiple copies of three distinct HA antigens. This simple, robust, and general approach can be used to produce self-assembling nanoparticle vaccines displaying HA antigens or combinations thereof in a repetitive array on the nanoparticle exterior. Shown are electron micrographs of nanoparticle-based vaccines co-displaying one or more copies of:

1) three different Group 1 HAs (H1, H5, and H6),
2) three different Group 2 HAs (H3, H7, and H10),
3) two different influenza B HAs (Yamagata and Victoria),
4) four HAs (H1, H3, Yamagata-lineage influenza B. and Victoria-lineage influenza B), or
5) eight HAs (H1, H3, H5, H6, H7, H10, Yamagata-lineage influenza B, and Victoria-lineage influenza B).

Nanoparticles displaying a single or multiple distinct HA antigens can be admixed and formulated as "cocktail" nanoparticle (np) vaccines with desired compositions. Nanoparticles co-displaying multiple distinct HA antigens are defined as "mosaic" nanoparticles (np) hereafter.

Figure 1A:
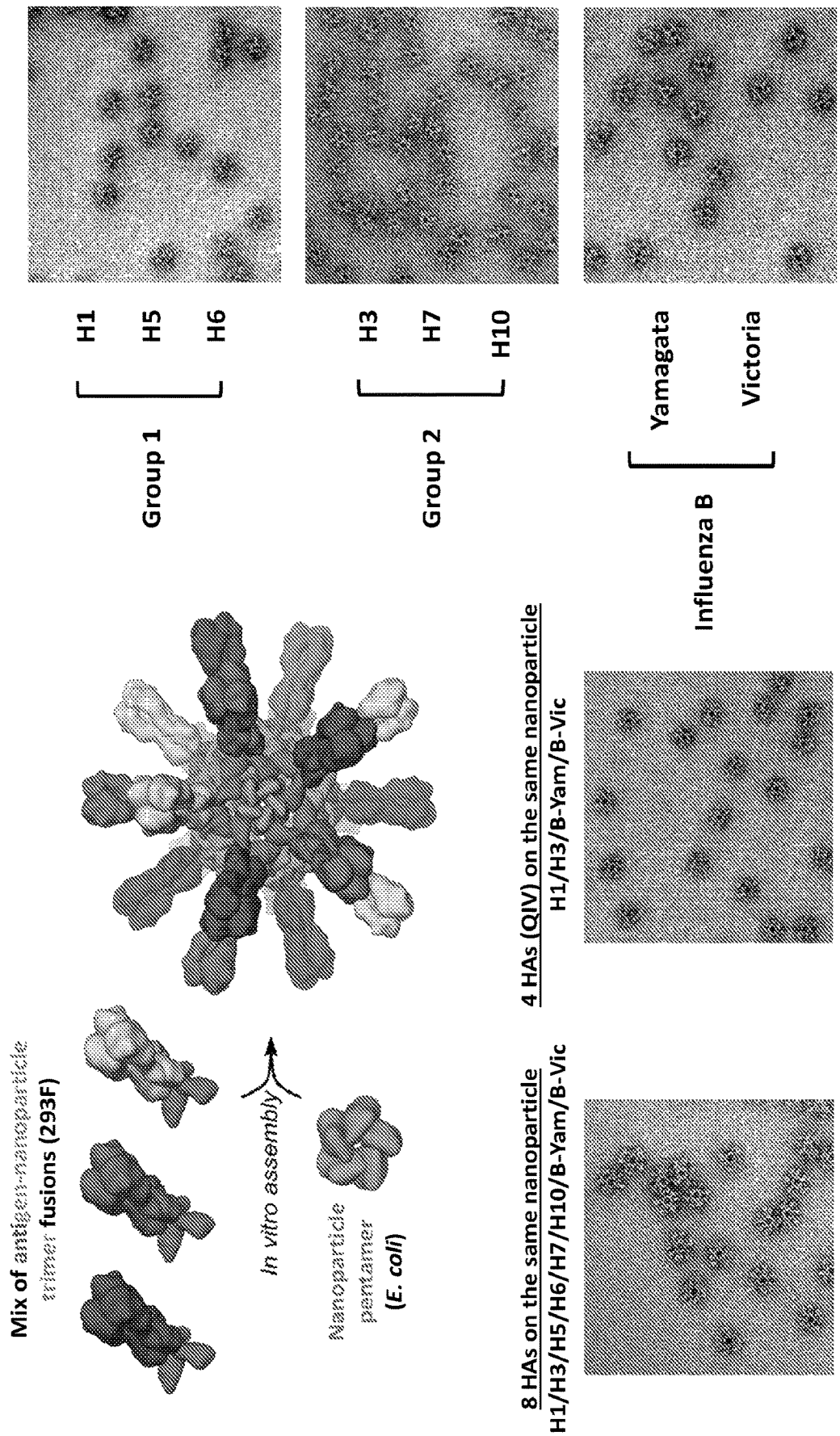
Figures 1, 1B:
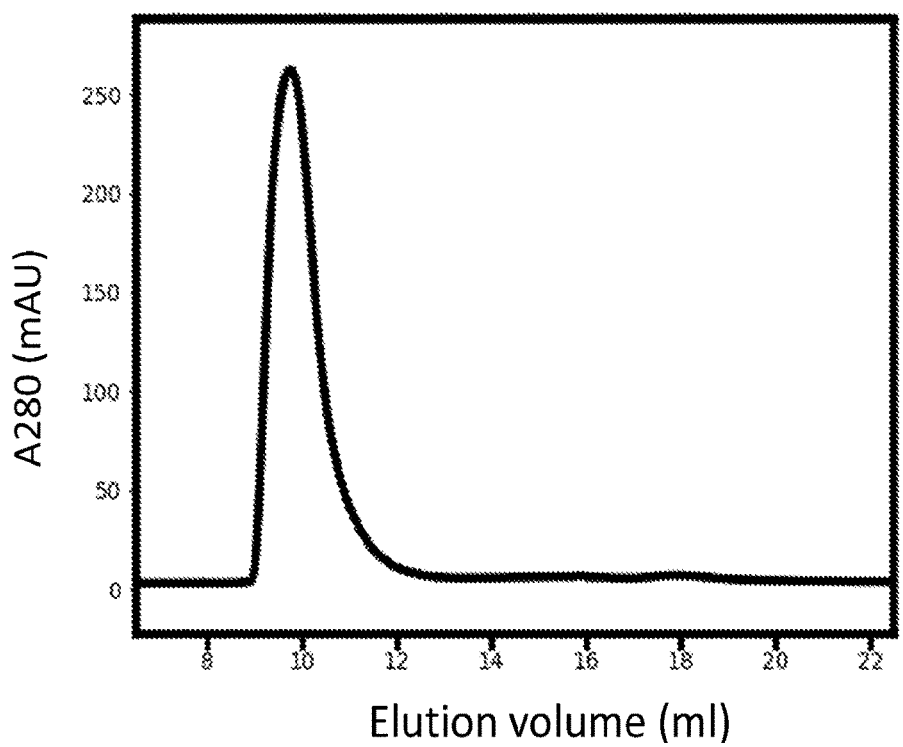
Figures 1, 1B, 2:
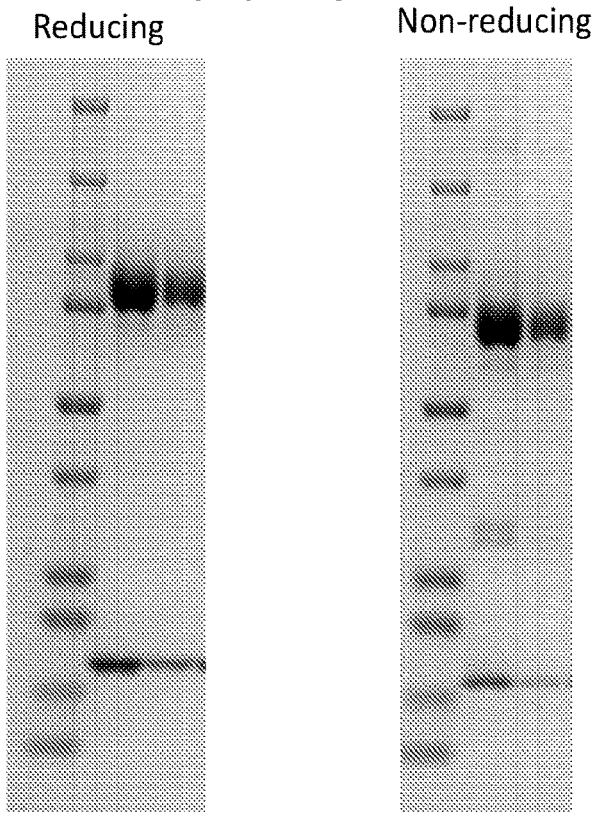
Figures 1, 1B, 2, 3:
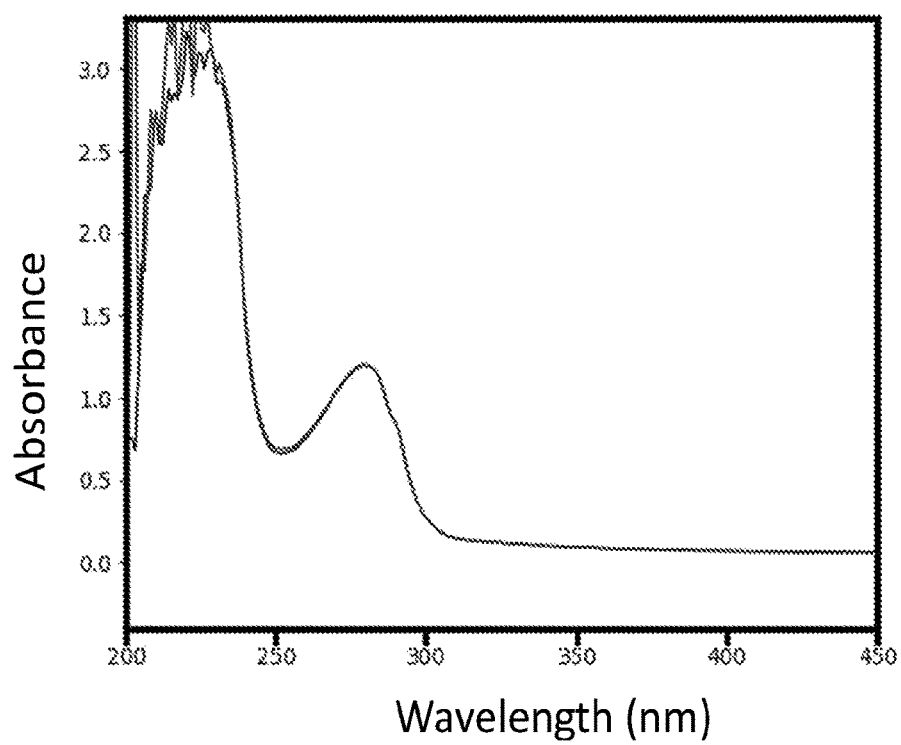

FIGS. 1B-1 to 1B-4 show the results of quality control testing for the production and assembly of the "H1-dn5 B" hemagglutinin protein construct displayed individually on I53-dn5 nanoparticles. FIG. 1B-1 shows exemplary results of size-exclusion chromatography (SEC) used to purify assembled nanoparticles from un-assembled components. FIG. 1B-2 shows an SDS-PAGE gel of SEC elution peaks used to confirm protein identities. FIG. 1B-3 shows the results of UV/Vis spectroscopy used to quantify protein and confirm minimal protein aggregation from the freeze-thaw process by comparing the spectrum before and after snap freezing and thawing. FIG. 1B-4 is a negative-stain transmission electron micrograph used to confirm the integrity of the nanoparticle after the freeze-thaw process.

Figures 1, 1B, 2, 3, 4:
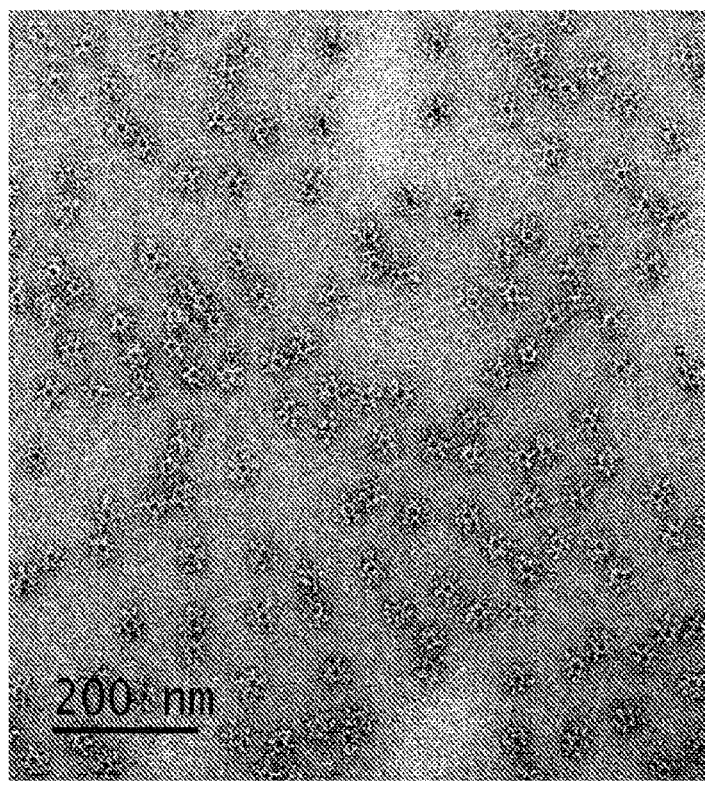
Figures 1, 1C:
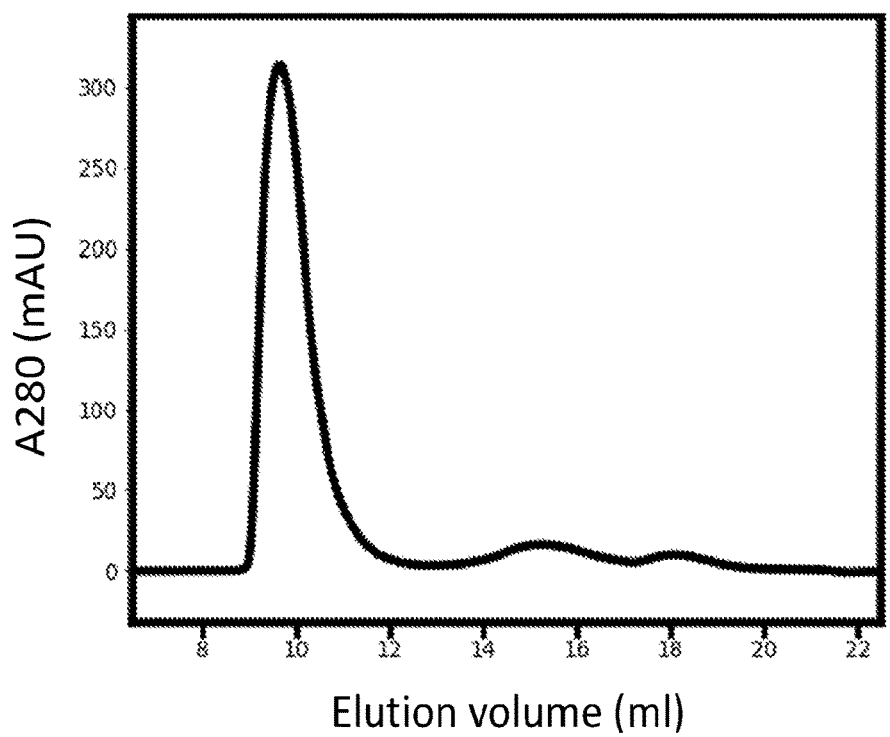
Figures 1, 1C, 2:
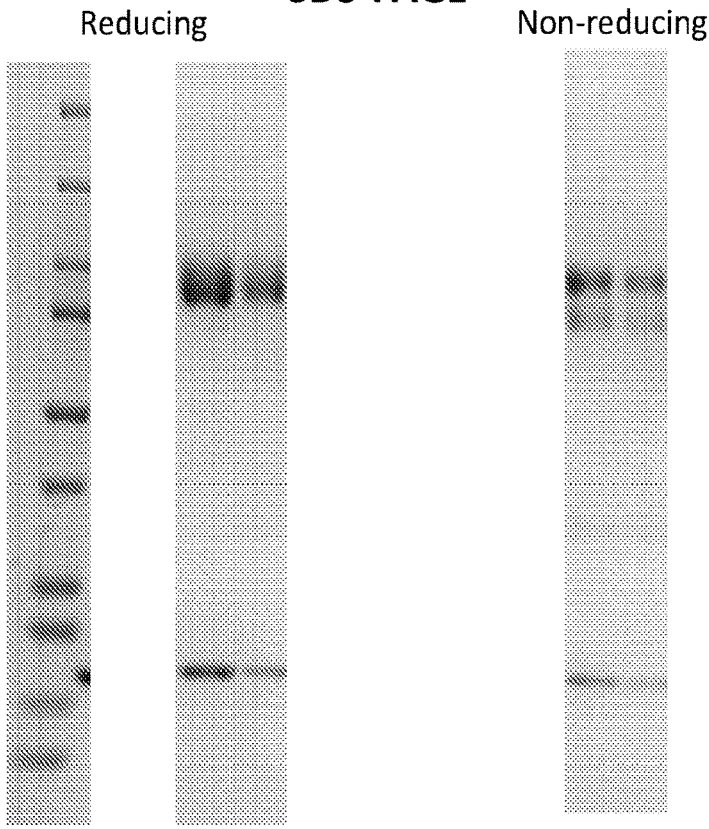
Figures 1, 1C, 2, 3:
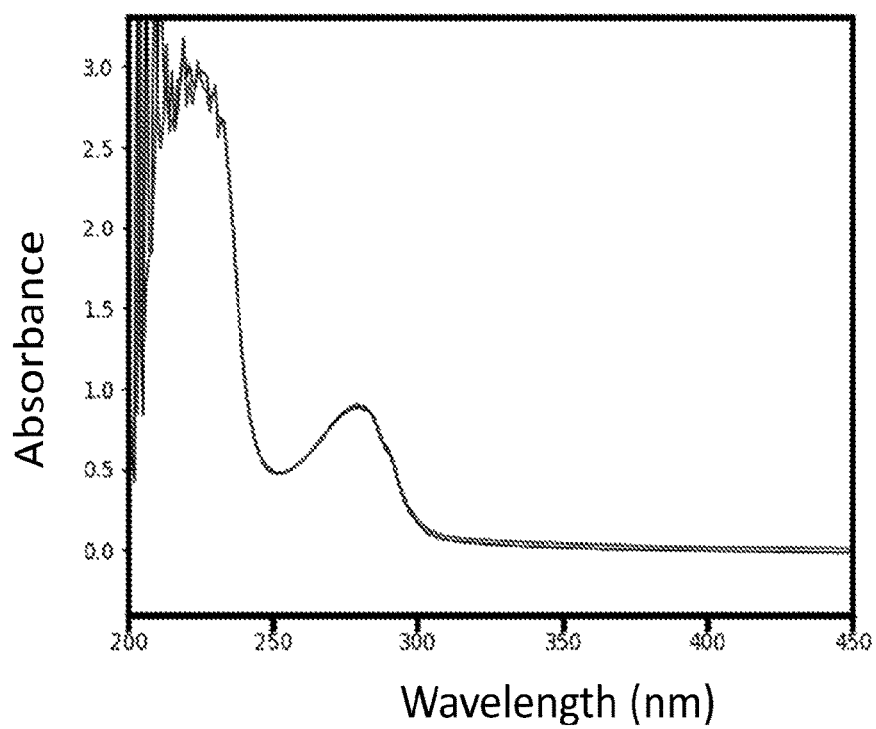
Figures 1, 1C, 2, 3, 4:
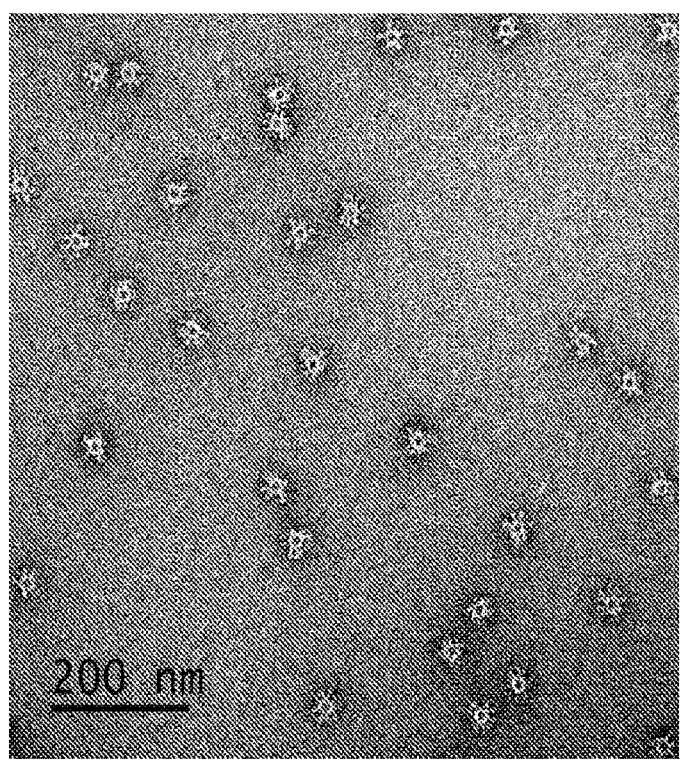

FIGS. 1C-1 to 1C-4 show the results of quality control testing for the production and assembly of the "H1-dn5 B", "H3-dn5 B", "Bvic-dn5 B" and "Byam-dn5 B" hemagglutinin protein constructs co-assembled and displayed on I53-dn5 nanoparticles. FIG. 1C-1 shows exemplary results of size-exclusion chromatography (SEC) used to purify assembled nanoparticles from un-assembled components. FIG. 1C-2 shows an SDS-PAGE gel of SEC elution peaks used to confirm protein identities and the presence of each of "H1-dn5 B", "H3-dn5 B", "Bvic-dn5 B", "Byam-dn5 B" and "I53-dn5 A". FIG. 1C-3 shows the results of UV/Vis spectroscopy used to quantify protein and confirm minimal protein aggregation from the freeze-thaw process by comparing the spectrum before and after snap freezing and thawing. FIG. 1C-4 is a negative-stain transmission electron micrograph used to confirm the integrity of the nanoparticle after the freeze-thaw process.

Figure 2A:
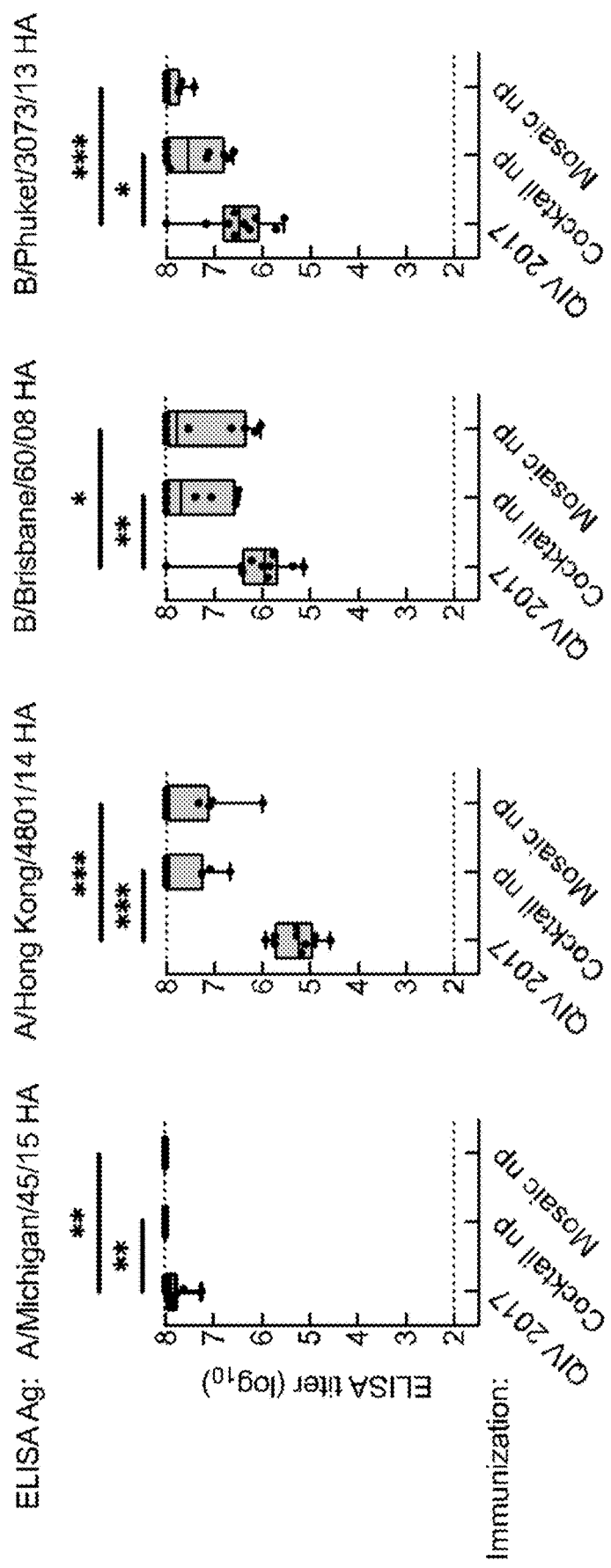
Figure 2B:
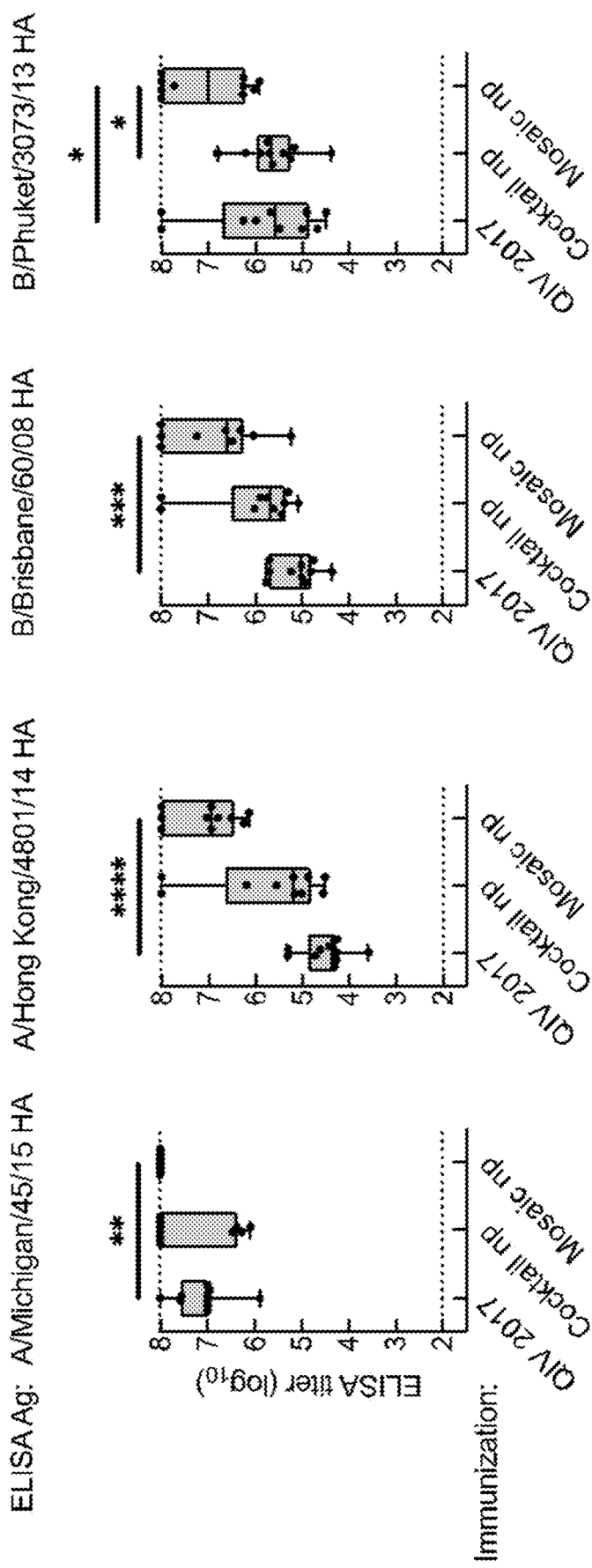

FIGS. 2A and 2B show HA-binding antibody titer to homologous virus HAs in mice immunized with different doses of either:

1) commercial quadrivalent influenza vaccine (QIV) for 2017-2018 season (QIV 2017);
2) cocktail nanoparticles (i.e., nanoparticle compositions comprising two or more separate nanoparticles, each displaying one or more copies of a single antigenic hemagglutinin peptide on its surface), or
3) mosaic nanoparticles (i.e., nanoparticles co-displaying one or more copies of two or more antigenic hemagglutinin peptides on each nanoparticle).

Figure 2C:
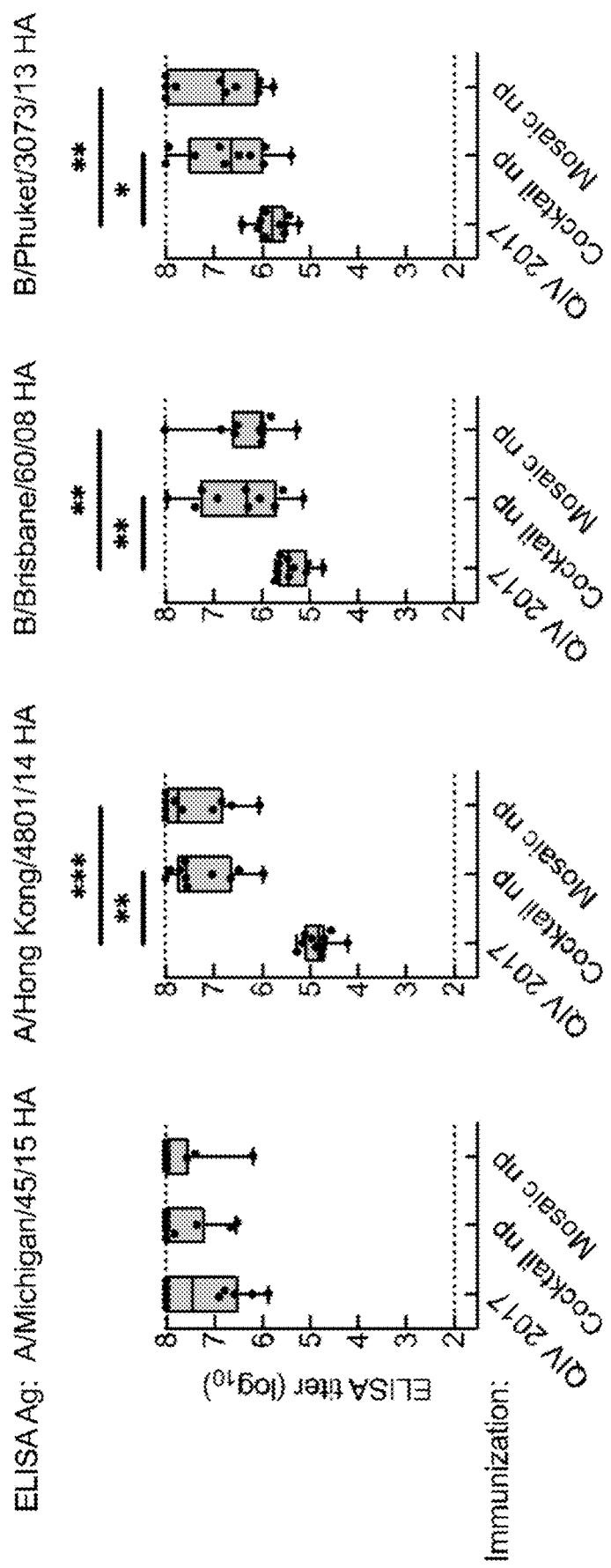

These vaccine preparations comprised HA antigens from A/Michigan/45/15 (H1N1), A/Hong Hong/4801/14 (H3N2), B/Brisbane/60/08 (Victoria lineage), and B/Phuket-3073/13 (Yamagata lineage). Serum antibody titer to HAs was measured at 2 weeks after the third immunization (week 10) with either Addavax™-adjuvanted immunogens at 6 µg (FIG. 2A) or immunogens without adjuvant at 6 µg (FIG. 2B) by ELISA. Similarly, serum antibody titer to homologous virus HAs was measured at 2 weeks after the third immunization (week 10) with Addavax™-adjuvanted immunogens at 0.6 µg (FIG. 2C) or 0.06 µg (FIG. 2D) by ELISA. In each figure, each Dot represents an endpoint titer of each mouse (N=10); each Box indicates upper and lower quartiles and whiskers indicate highest and lowest data points in each dataset; median is shown as a line in each box.

Figure 3A:
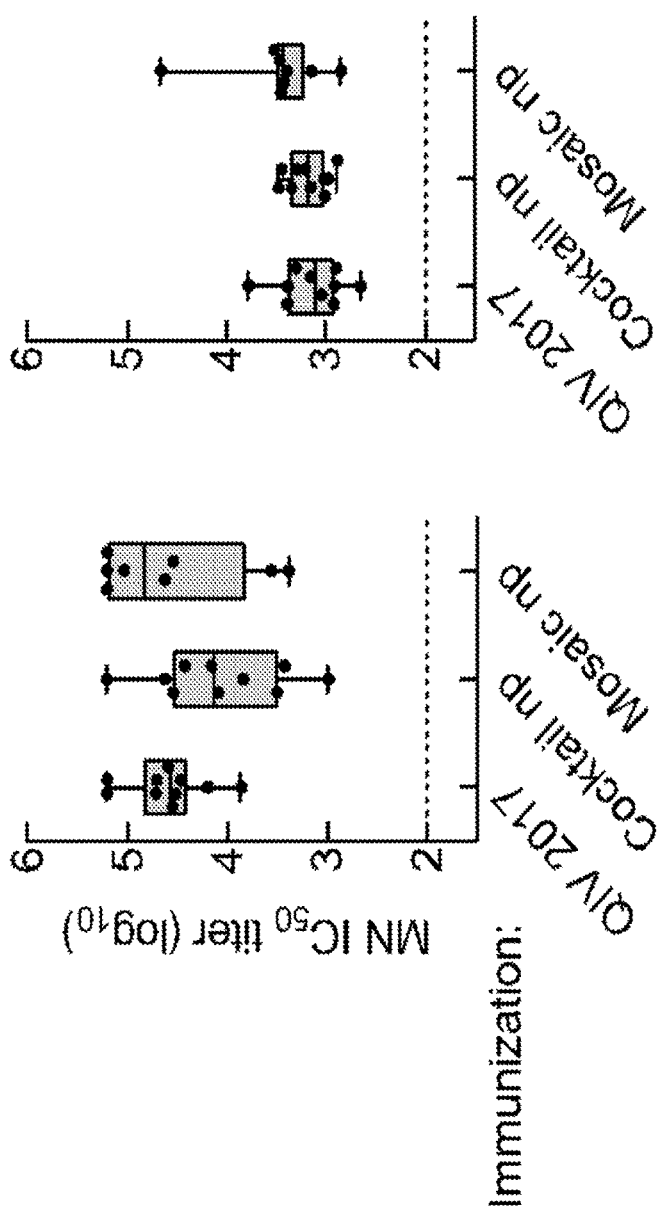
Figure 3B:
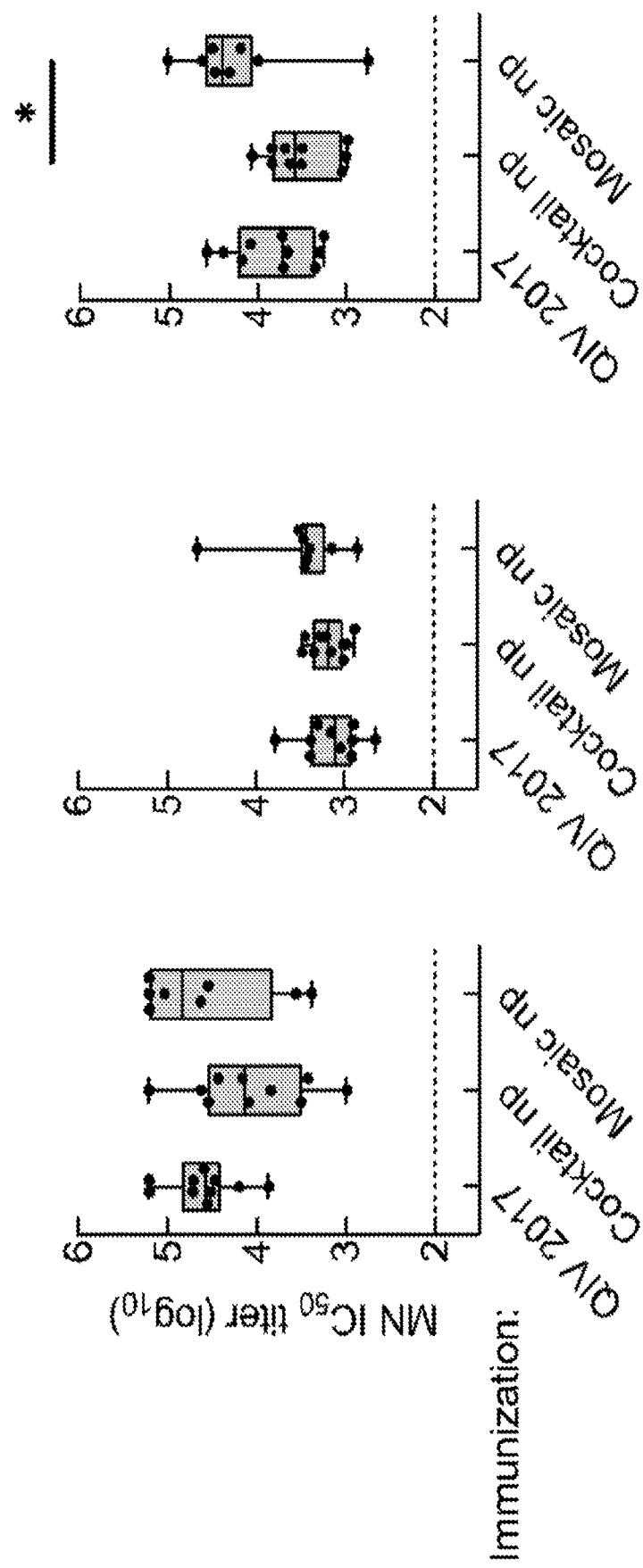
Figure 4:
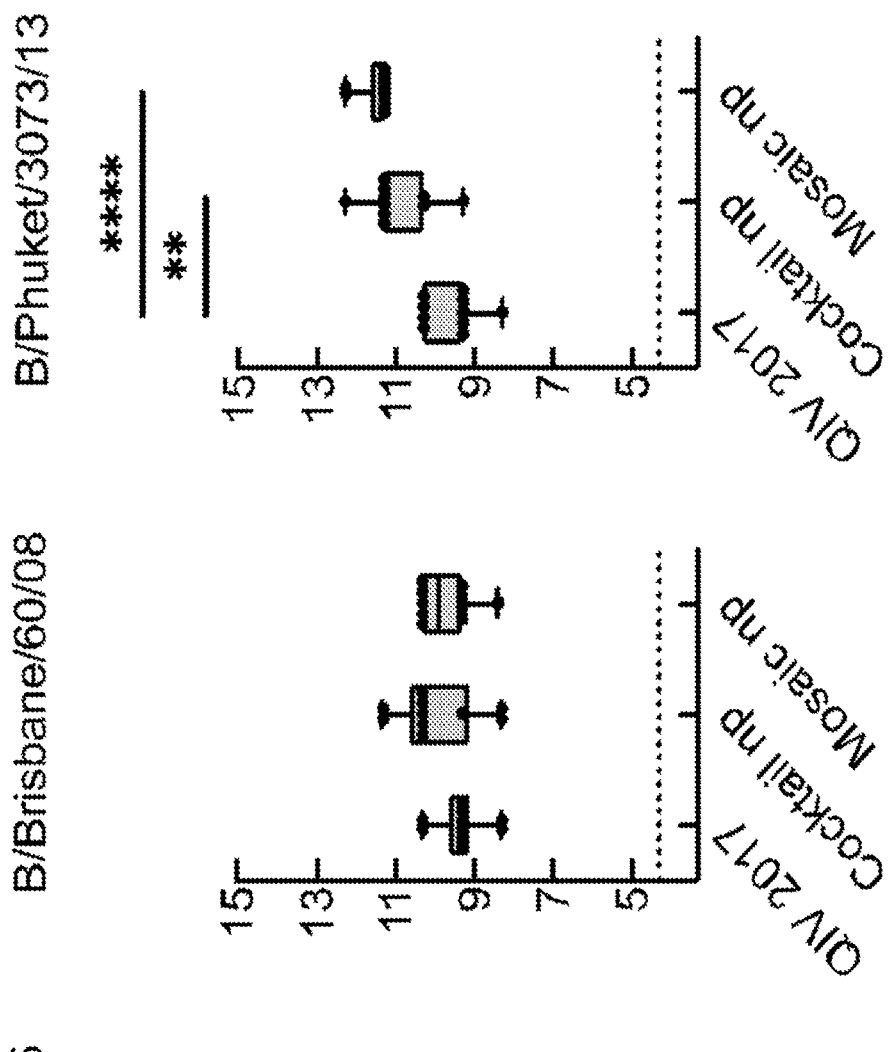

FIGS. 3A and 3B show virus-neutralizing antibody titer to homologous virus in mice immunized with 6 µg of the same commercial QIV 2017, cocktail nanoparticles, or mosaic nanoparticles. Serum microneutralization (MN) titer to viruses was measured at 2 weeks after the third immunization (week 10) with either Addavax™-adjuvanted immunogens (FIG. 3A) or immunogens without adjuvant (FIG. 3B) by a reporter-based MN assay. In each figure, each Dot represents a half-maximal inhibitory serum dilution ($IC_{50}$) titer of each mouse (N=10); each Box indicates upper and lower quartiles and whiskers indicate highest and lowest data points in each dataset; Median is shown as a line in each box.

FIG. 4 shows hemagglutination inhibitory (HAI) antibody titer to homologous virus in mice immunized with the same 6 µg of commercial QIV 2017, cocktail nanoparticles, or mosaic nanoparticles. Serum HAI antibody titer to viruses was measured at 2 weeks after the third immunization (week 10) with Addavax™-adjuvanted immunogens by using Turkey red blood cells. In this figure, each Dot represents endpoint titer of each mouse (N=10); each Box indicates upper and lower quartiles and whiskers indicate highest and lowest data points in each dataset; Median is shown as a line in each box.

Figure 5A:
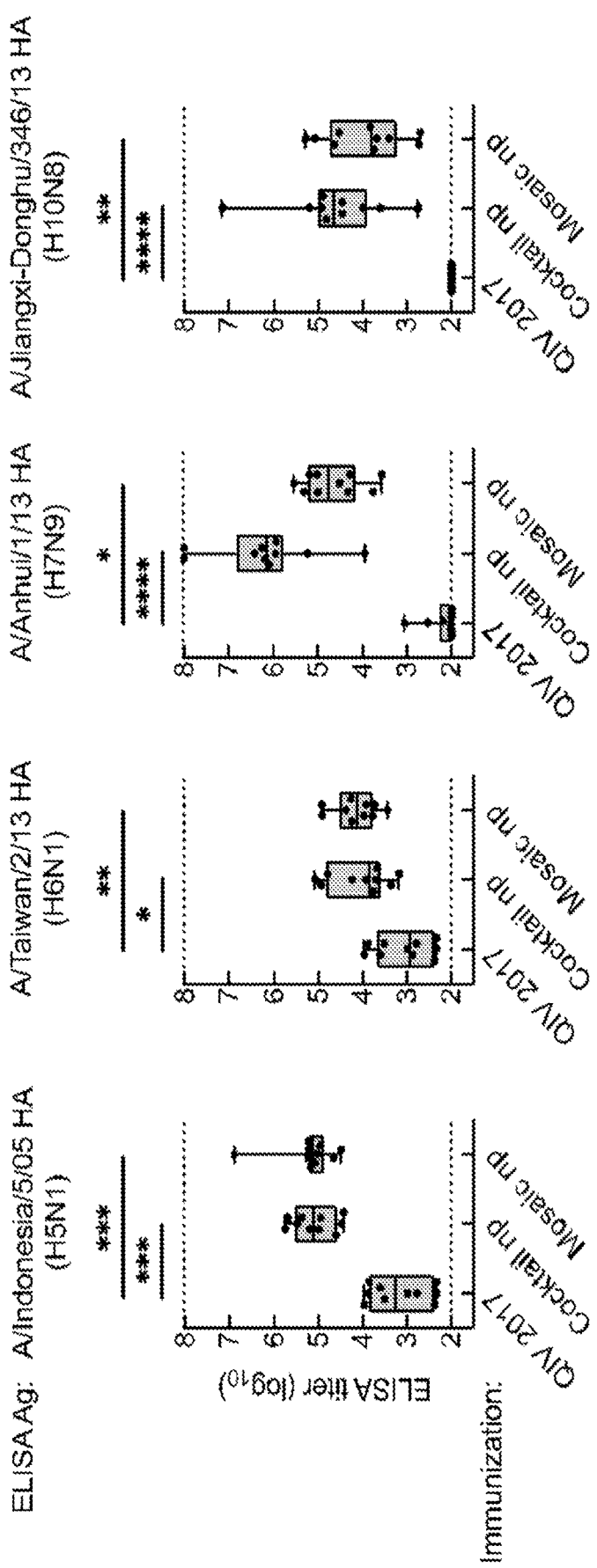
Figure 5B:
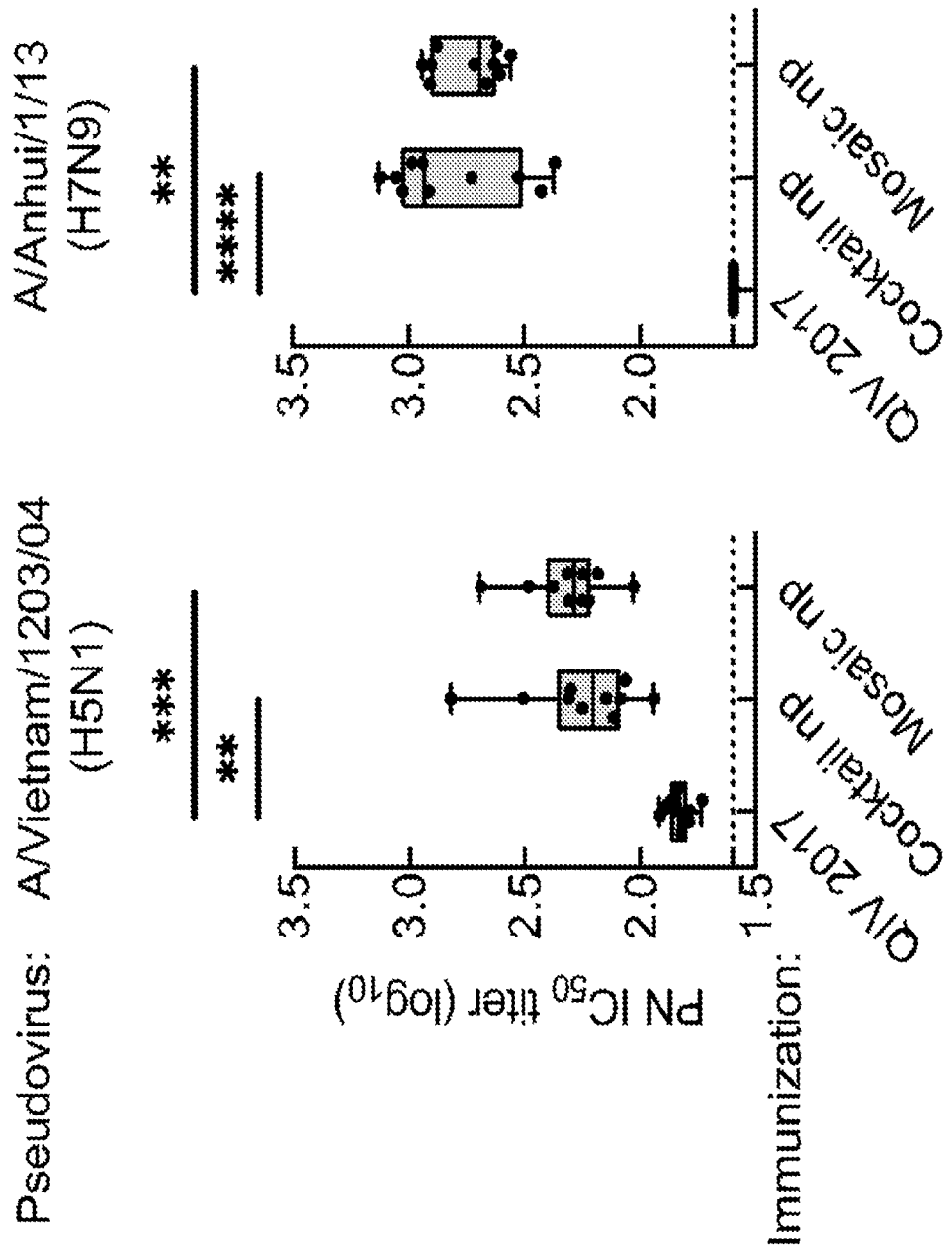

FIGS. 5A and 5B show antibody responses to heterosubtypic virus HAs in mice immunized with 6 µg of the commercial QIV 2017, cocktail nanoparticles, or mosaic nanoparticles with Addavax™ adjuvant. Serum antibody titer to heterosubtypic HAs (FIG. 5A) and neutralizing antibody titer to H5N1 or H7N9 pseudoviruses (FIG. 5B) was measured at 2 weeks after the third immunization (week 10) by ELISA and pseudotype virus neutralization assays, respectively. In these figures, each Dot represents endpoint titer (FIG. 5A) or neutralization $IC_{50}$ titer (FIG. 5B) of each mouse (N=10); each Box indicates upper and lower quartiles and whiskers indicate highest and lowest data points in each dataset; Median is shown as a line in each box.

Figure 6A:
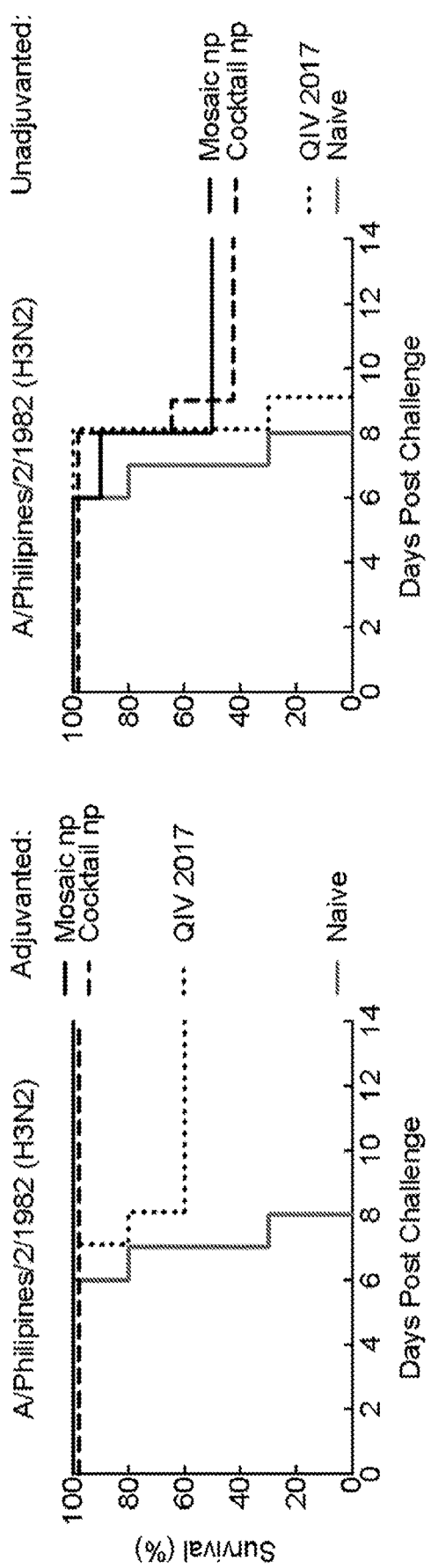
Figure 6B:
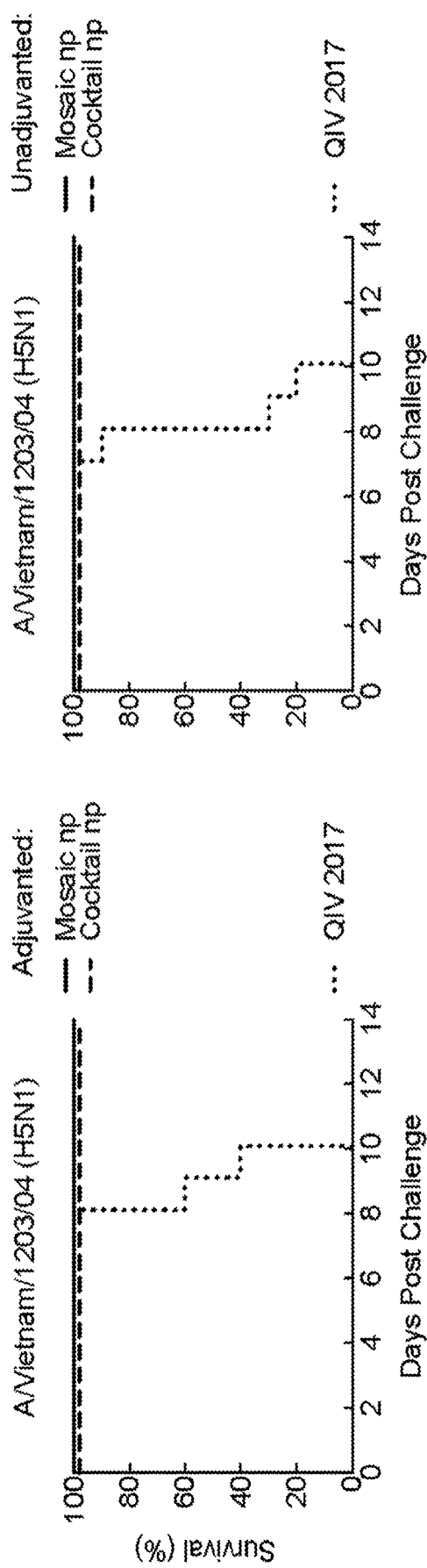

FIGS. 6A and 6B show the results of experimental challenge with vaccine-mismatched H3N2 and heterosubtypic H5N1 viruses in mice immunized with 6 µg of the commercial QIV 2017, cocktail nanoparticles, or mosaic nanoparticles. Mice were challenged 10-14 weeks after the third immunization (week 18-22) with either Addavax™-adjuvanted immunogens (left) or immunogens without an adjuvant (right) with vaccine-mismatched H3N2 (FIG. 6A) or heterosubtypic H5N1 (FIG. 6B) virus. Each survival curve after experimental virus infection was plotted on Kaplan-Meier plots (N=10).

Figure 7:
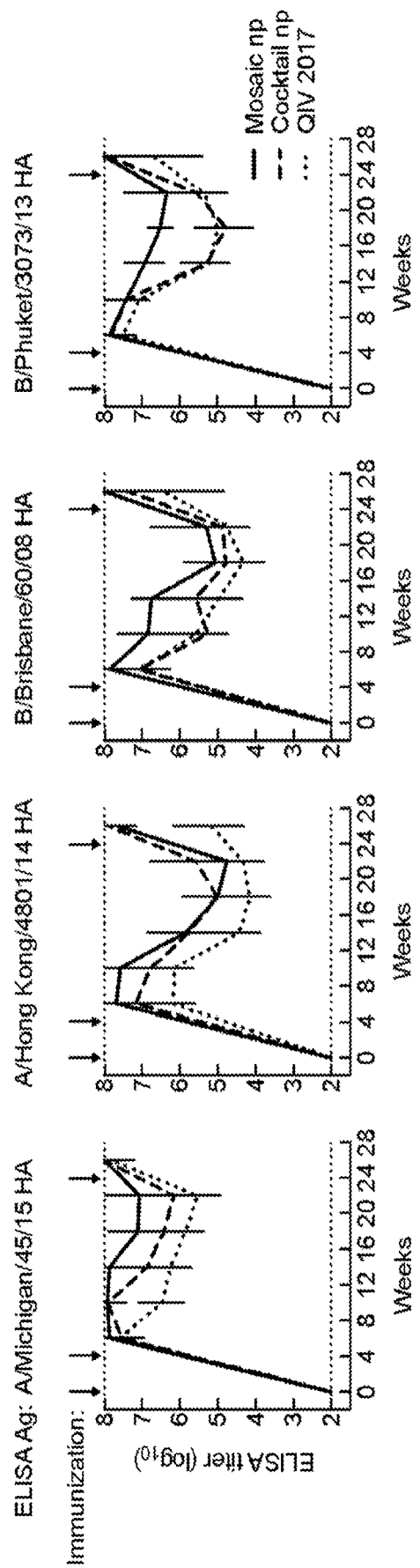

FIG. 7 shows HA-binding antibody titer to homologous virus HAs in mice immunized with 6 µg of the commercial QIV 2017, cocktail nanoparticles, or mosaic nanoparticles with Addavax™ adjuvant. Serum antibody titer to HAs was measured periodically after immunizations by ELISA. Each line represents geometric mean endpoint titer of each immunization group with geometric standard deviation shown as vertical whiskers (N=10). Immunizations were given at weeks 0, 4, and 24.

Figure 8A:
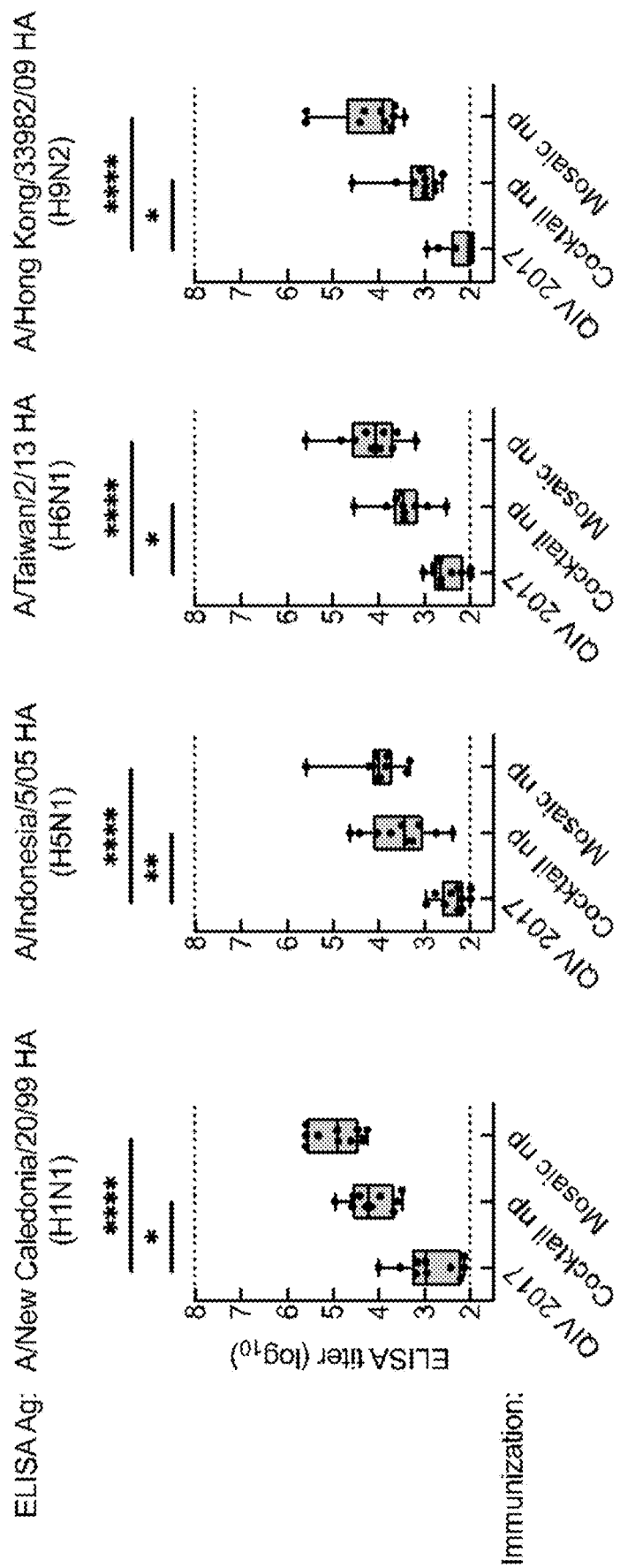
Figure 8B:
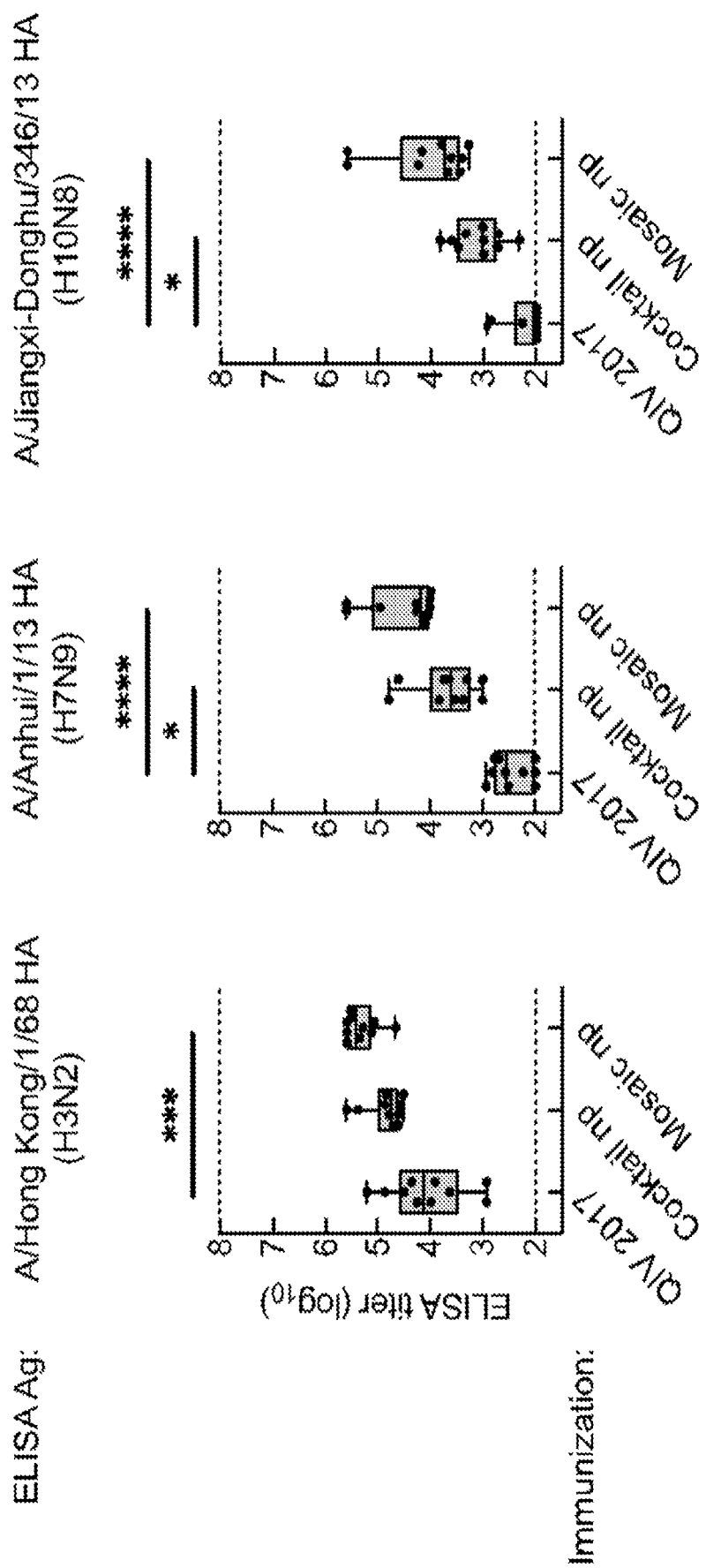

FIGS. 8A and 8B show HA-binding antibody titer to antigen-mismatched and heterosubtypic virus HAs in mice immunized with 6 µg of the commercial QIV 2017, cocktail nanoparticles, or mosaic nanoparticles with Addavax™ adjuvant. Serum antibody titer to various group 1 HAs (FIG. 8A) and group 2 HAs (FIG. 8B) was measured at 2 weeks after the third immunization (week 26) by ELISA. In these figures, each Dot represents endpoint titer of each mouse (N=10); each Box indicates upper and lower quartiles and whiskers indicate highest and lowest data points in each dataset; Median is shown as a line in each box.

Figure 9:
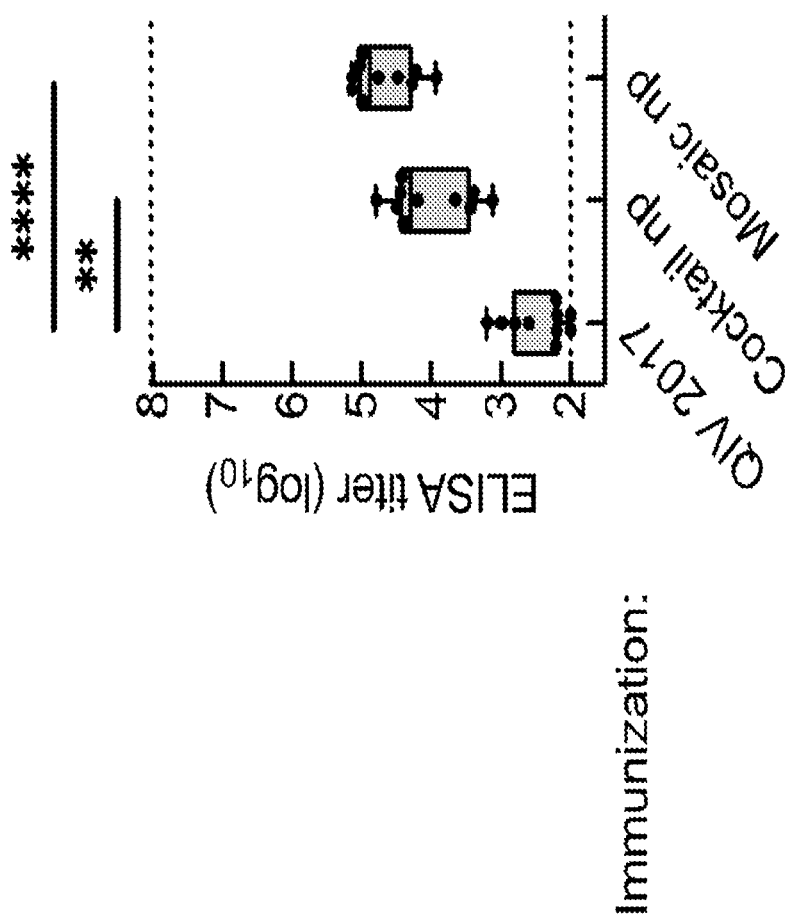

FIG. 9 shows antibody responses to the stem region of HA in mice immunized with 6 µg of the commercial QIV 2017, cocktail nanoparticles, or mosaic nanoparticles with Addavax™ adjuvant. Serum antibody titer to group 1 stem-only HA was measured at 2 weeks after the third immunization (week 26) by ELISA. In this figure, each Dot represents endpoint titer of each mouse (N=10); each Box indicates upper and lower quartiles and whiskers indicate highest and lowest data points in each dataset; Median is shown as a line in each box.

Figure 10:
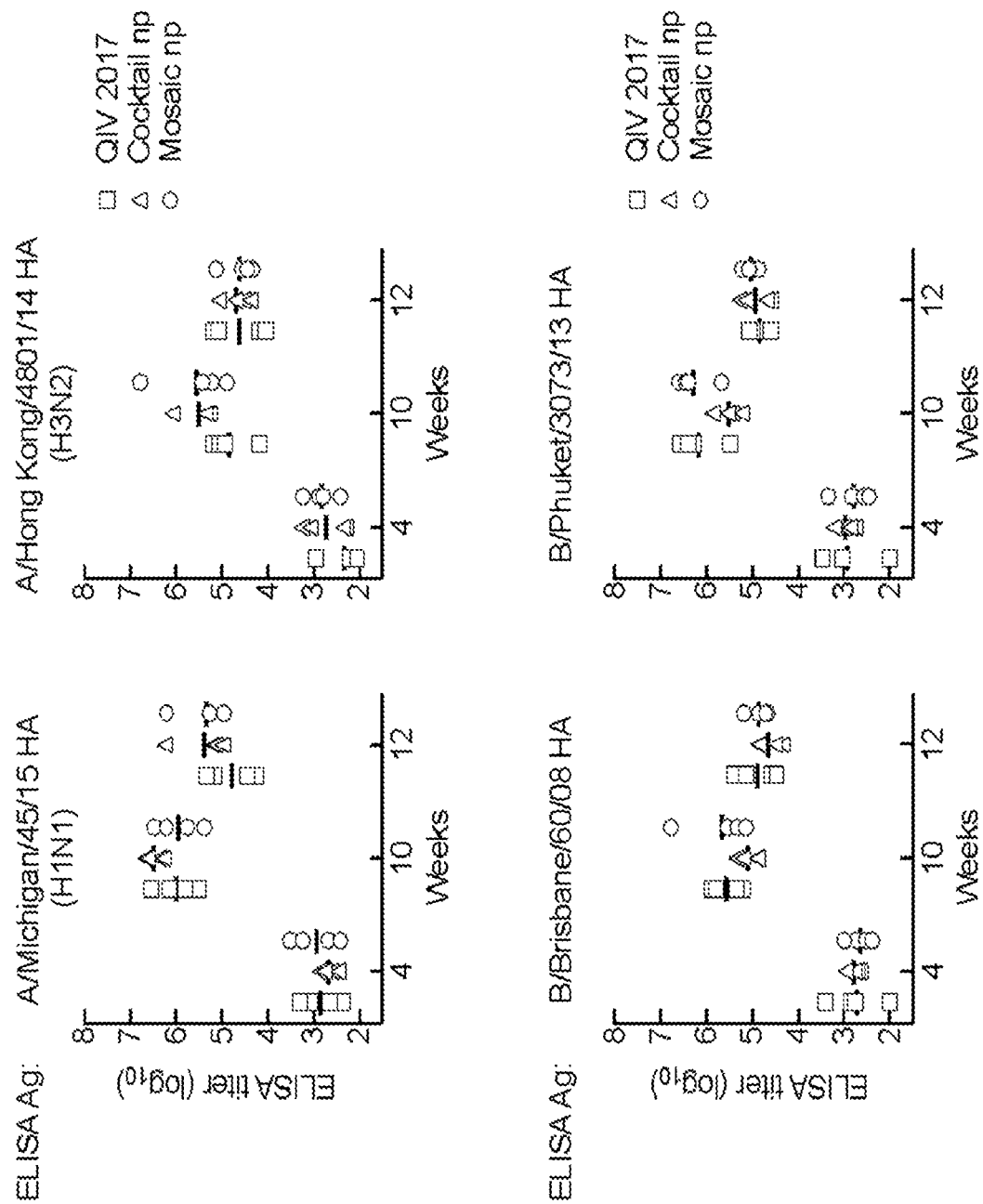

FIG. 10 shows HA-binding antibody titer to homologous virus HAs in rhesus macaques immunized with 60 µg of the commercial QIV 2017, cocktail nanoparticles, or mosaic nanoparticles with Addavax™ adjuvant. Serum antibody titer to homologous HAs was measured at 4 weeks after the first (week 4) and 2 and 4 weeks after the second immunization (weeks 10 and 12, respectively) by ELISA. In this figure, each Dot represents an endpoint titer of each monkey (N=4). Geometric mean is shown as a line for each group.

Figure 11:
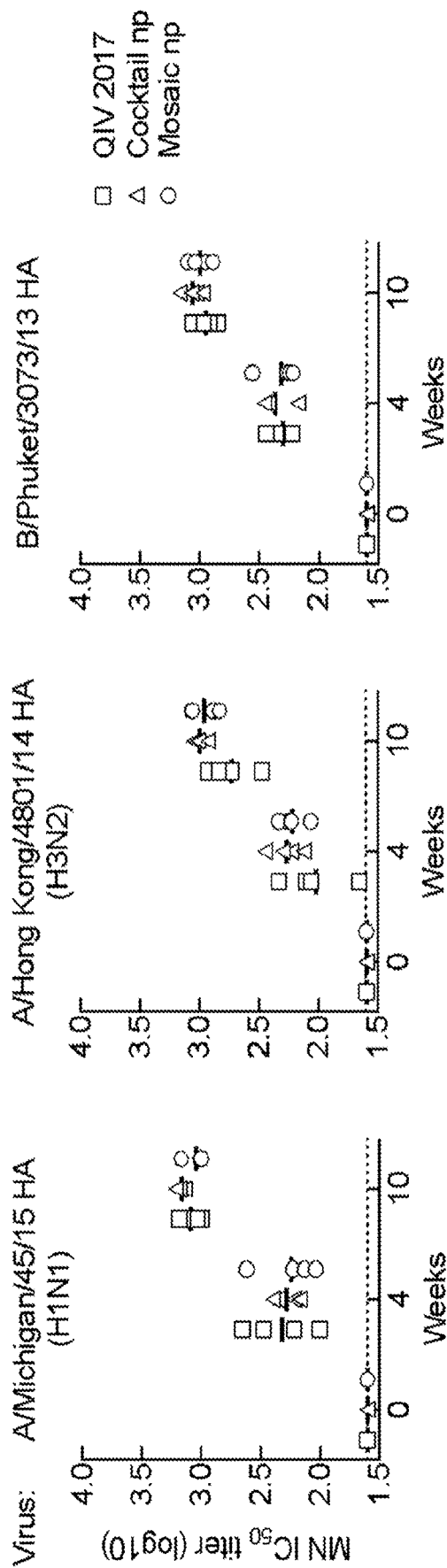

FIG. 11 shows virus neutralizing antibody titer to homologous viruses in rhesus macaques immunized with 60 µg of the commercial QIV 2017, cocktail nanoparticles, or mosaic nanoparticles with Addavax™ adjuvant. Serum neutralizing antibody titer to homologous viruses was measured at before immunization (week 0), 4 weeks after the first (week 4) and 2 weeks after the second immunization (week 10) by reporter-based microneutralization (MN) assays. In this figure, each Dot represents neutralization $IC_{50}$ titer of each monkey (N=4). Geometric mean is shown as a line for each group.

Figure 12:
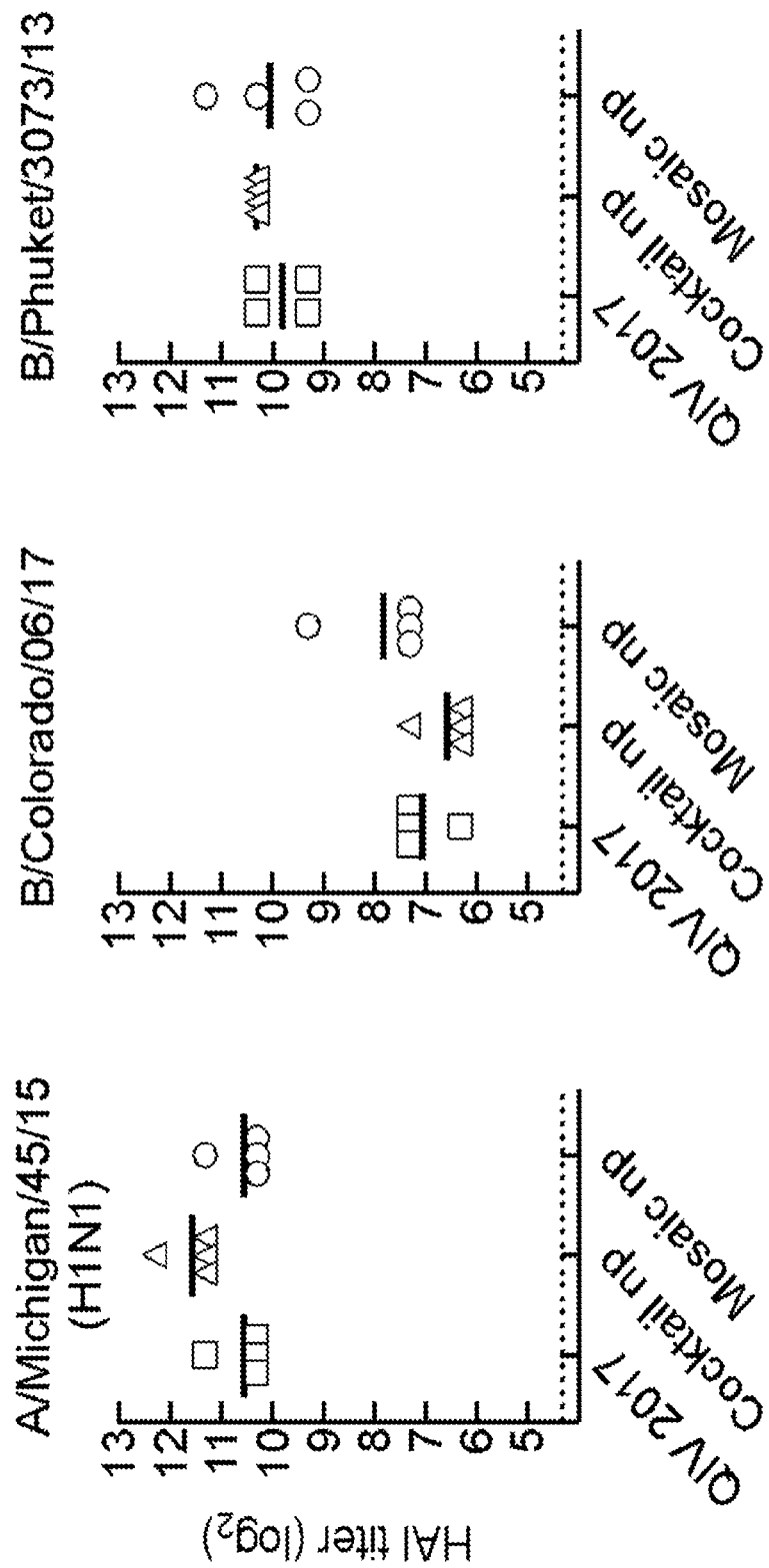

FIG. 12 shows HAI antibody titer to homologous viruses in rhesus macaques immunized with 60 µg of the commercial QIV 2017, cocktail nanoparticles, or mosaic nanoparticles with Addavax™ adjuvant. Serum HAI antibody titer to homologous viruses was measured at 2 weeks after the second immunizations (weeks 10) using Turkey red blood cells. In this figure, each Dot represents neutralization $IC_{50}$ titer of each monkey (N=4). Geometric mean is shown as a line for each group.

Figure 13:
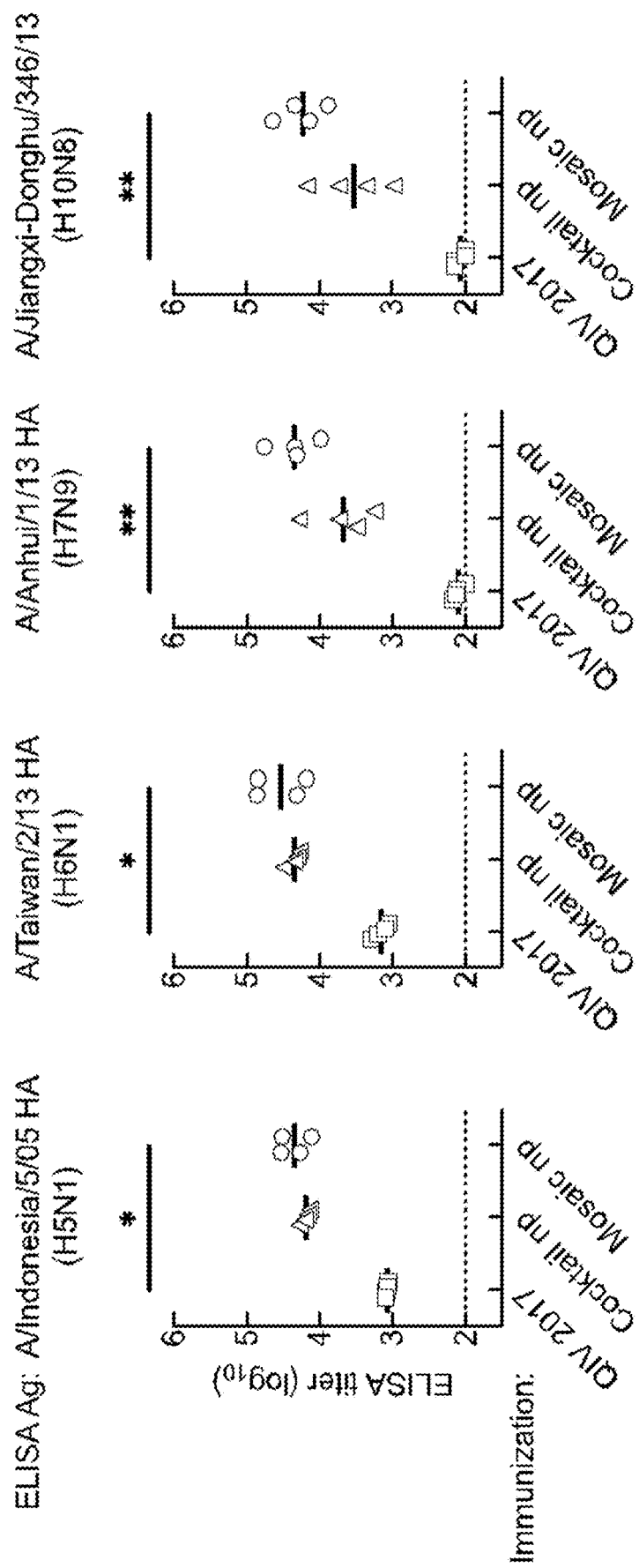

FIG. 13 shows HA-binding antibody titer to heterosubtypic HAs in rhesus macaques immunized with 60 µg of the commercial QIV 2017, cocktail nanoparticles, or mosaic nanoparticles with Addavax™ adjuvant. Serum antibody titer to heterosubtypic HAs was measured at 2 weeks after the second immunization (week 10) by ELISA. In this figure, each Dot represents endpoint titer of each monkey (N=4). Geometric mean is shown as a line for each group.

Figure 14:
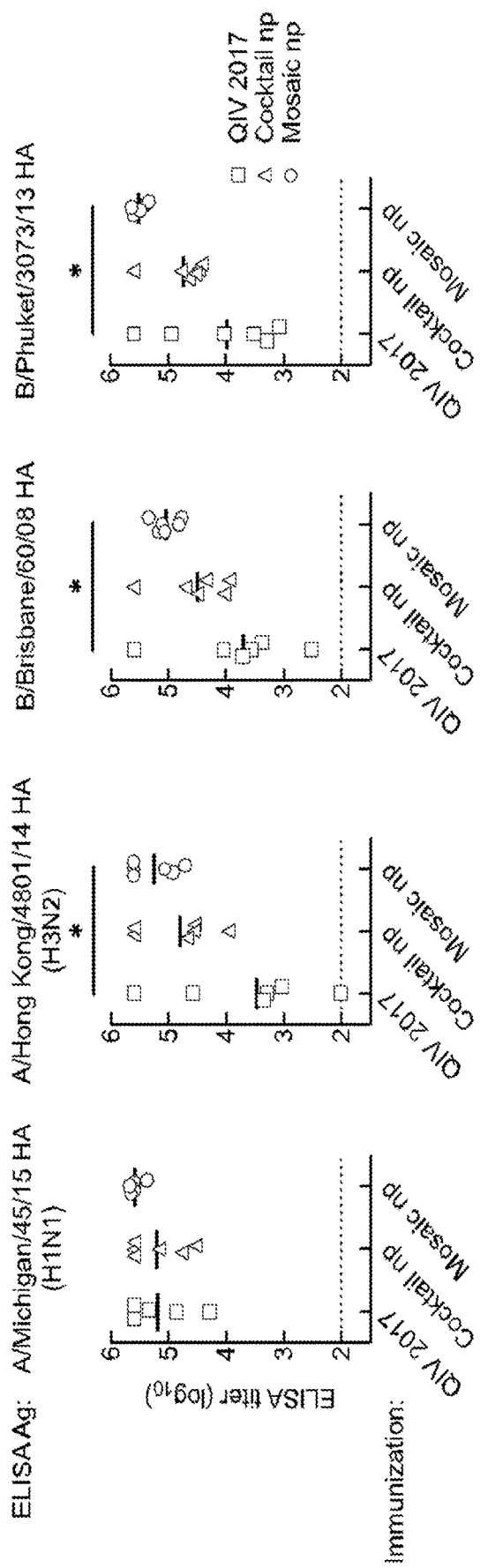

FIG. 14 shows HA-binding antibody titer to homologous HAs in ferrets immunized with 20 µg of the commercial QIV 2017, cocktail nanoparticles, or mosaic nanoparticles with Addavax adjuvant. Serum antibody titer to homologous HAs was measured at 2 weeks after the second immunization (week 6) by ELISA. In this figure, each Dot represents endpoint titer of each ferrets (N=6). Geometric mean is shown as a line for each group.

Figure 15:
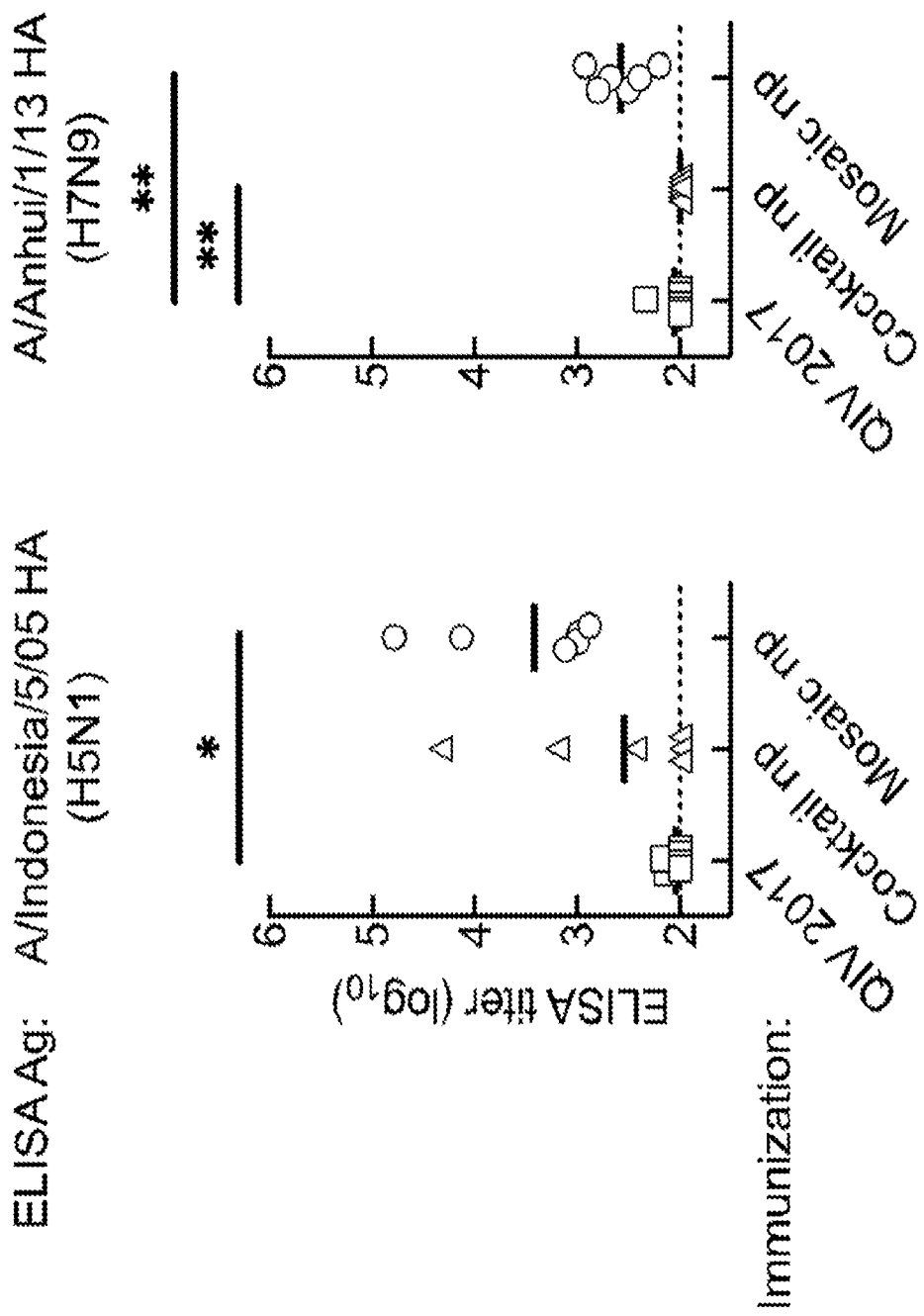

FIG. 15 shows HA-binding antibody titer to heterosubtypic HAs in ferrets immunized with 20 μg of the commercial QIV 2017, cocktail nanoparticles, or mosaic nanoparticles with Addavax™ adjuvant. Serum antibody titer to heterosubtypic HAs was measured at 2 weeks after the second immunization (week 6) by ELISA. In this figure, each Dot represents endpoint titer of each ferret (N=6). Geometric mean is shown as a line for each group.

Figure 16:
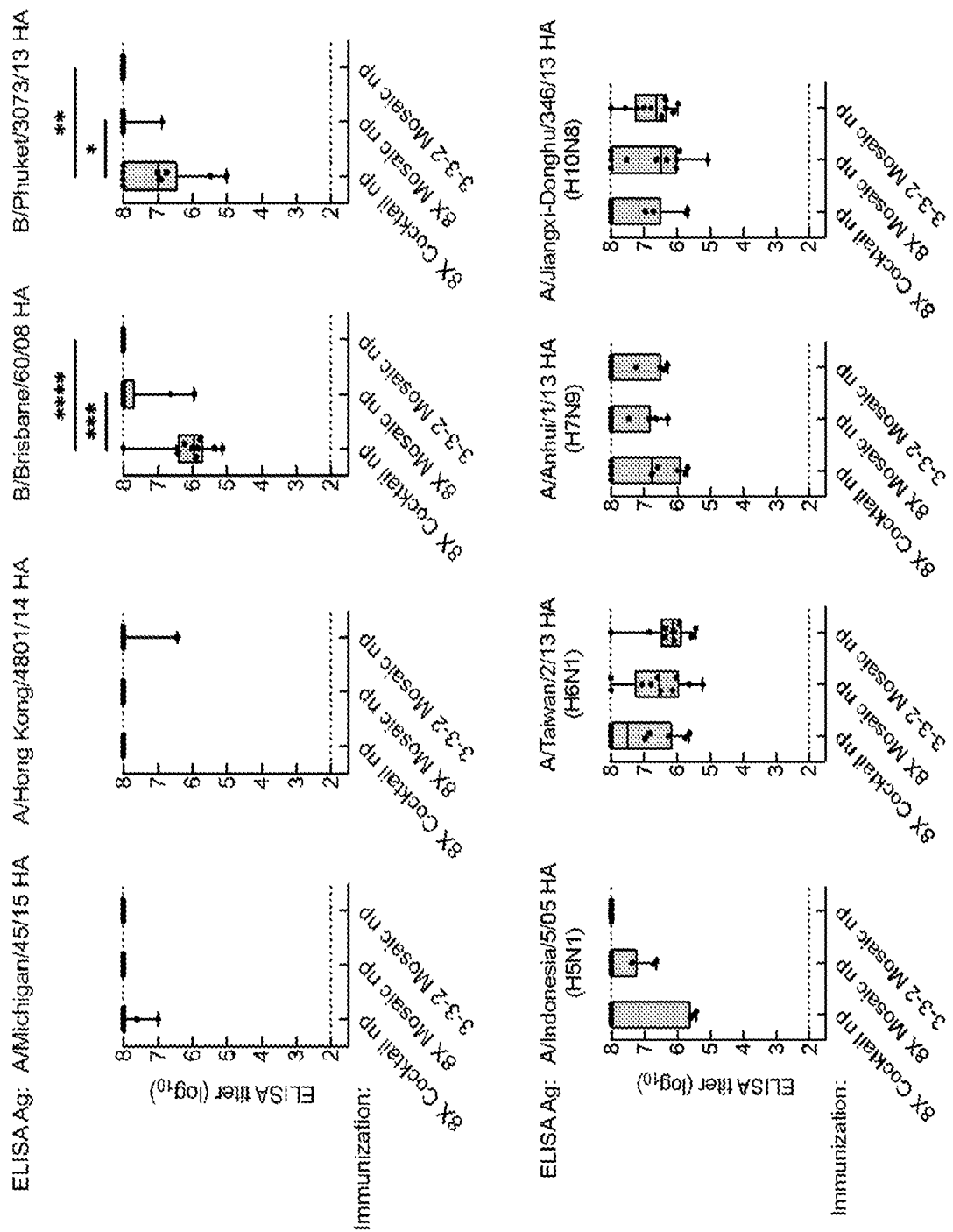

FIG. 16 shows the HA-binding antibody titers to homologous virus HAs in mice immunized with 6 μg of multi-subtypic cocktail nanoparticles (i.e., cocktail nanoparticles comprising multiple HA antigens from different HA subtypes), or mosaic nanoparticles with Addavax™ adjuvant. The HA antigens present in the octavalent nanoparticles are derived from: A/Michigan/45/15 (H1N1), A/Hong Kong/4801/14 (H3N2), B/Brisbane/60/08 (Victoria lineage), B/Phuket/3073/13 (Yamagata lineage), A/Indonesia/5/05 (H5N1), A/Taiwan/2/13 (H6N1), A/Anhui/1/13 (H7N9), and A/Jiangxi-Donghu/346/13 (H10N8). The 3-3-2 mosaic nanoparticles are an admixture of three mosaic nanoparticles each co-displaying either a set of 3 Group 1 HAs, 3 Group 2 HAs, or 2 lineages of Type B HAs. Serum antibody titer to homologous virus HAs was measured at 2 weeks after the third immunization (week 10) with Addavax™-adjuvanted immunogens by ELISA. In these figures, each Dot represents endpoint titer of each mouse (N=10); each Box indicates upper and lower quartiles and whiskers indicate highest and lowest data points in each dataset; Median is shown as a line in each box.

Figure 17:
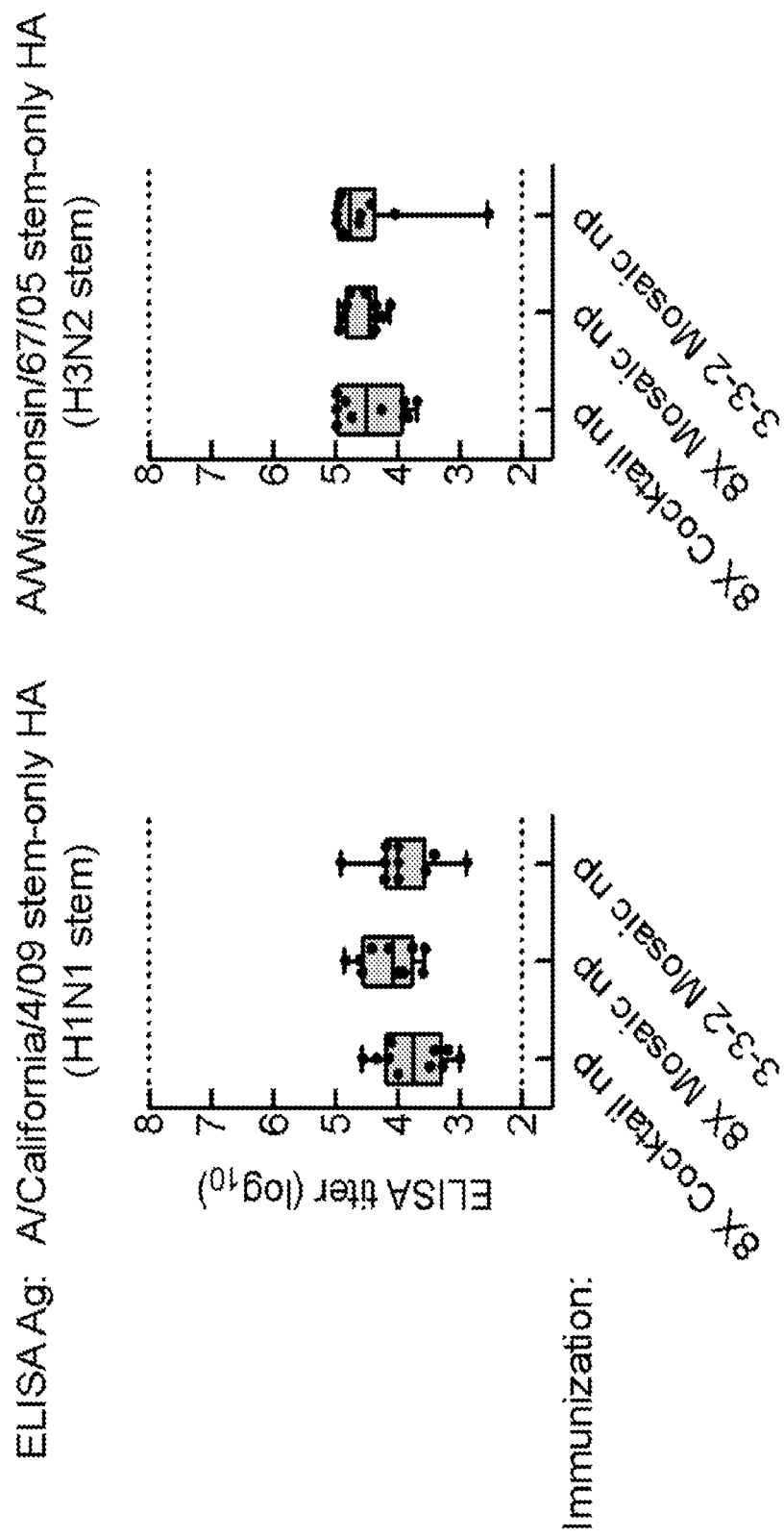

FIG. 17 shows antibody responses to the stem region of HA in mice immunized with 6 μg of octavalent cocktail nanoparticles, or mosaic nanoparticles with Addavax™ adjuvant. Serum antibody titer to group 1 stem-only HA (left) and group 2 stem-only HA (right) was measured at 2 weeks after the third immunization (week 10) by ELISA. In this figure, each Dot represents endpoint titer of each mouse (N=10); each Box indicates upper and lower quartiles and whiskers indicate highest and lowest data points in each dataset; Median is shown as a line in each box.

Figure 18:
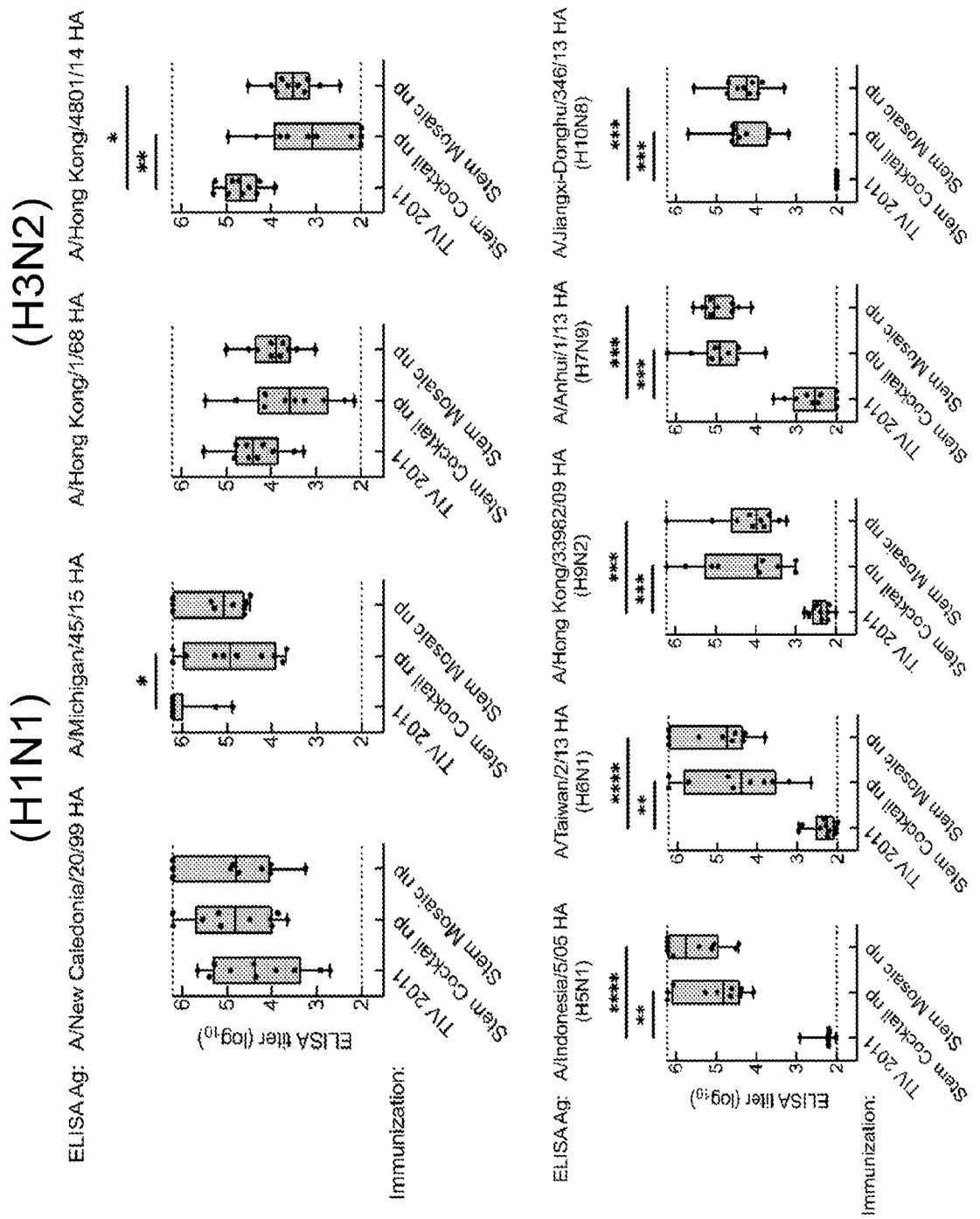

FIG. 18 shows HA-binding antibody titer to homologous and heterosubtypic virus HAs in mice immunized with 6 μg of commercial trivalent influenza vaccine (TIV) for 2011-2012 season (TIV 2011), stem cocktail nanoparticles, or stem mosaic nanoparticles with Addavax adjuvant. These stem cocktail nanoparticles consisted of four separate nanoparticles each displaying one or more copies of a single stem-only HA (two group 1 and two group 2 stem-only HAs) on its surface. These stem mosaic nanoparticles co-displayed one or more copies of each of the same set of four stem-only HAs on each particle. Stem-only HA antigens were derived from: A/Singapore/1/57 (H2N2), A/Indonesia/5/05 (H5N1), A/Anhui/1/13 (H7N9), and A/Jiangxi-Donghu/346/13 (H10N8). Serum antibody titer to HAs was measured at 2 weeks after the third immunization (week 10) with Addavax™-adjuvanted immunogens by ELISA. In these figures, each Dot represents endpoint titer of each mouse (N=10); each Box indicates upper and lower quartiles and whiskers indicate highest and lowest data points in each dataset; Median is shown as a line in each box.

Figure 19:
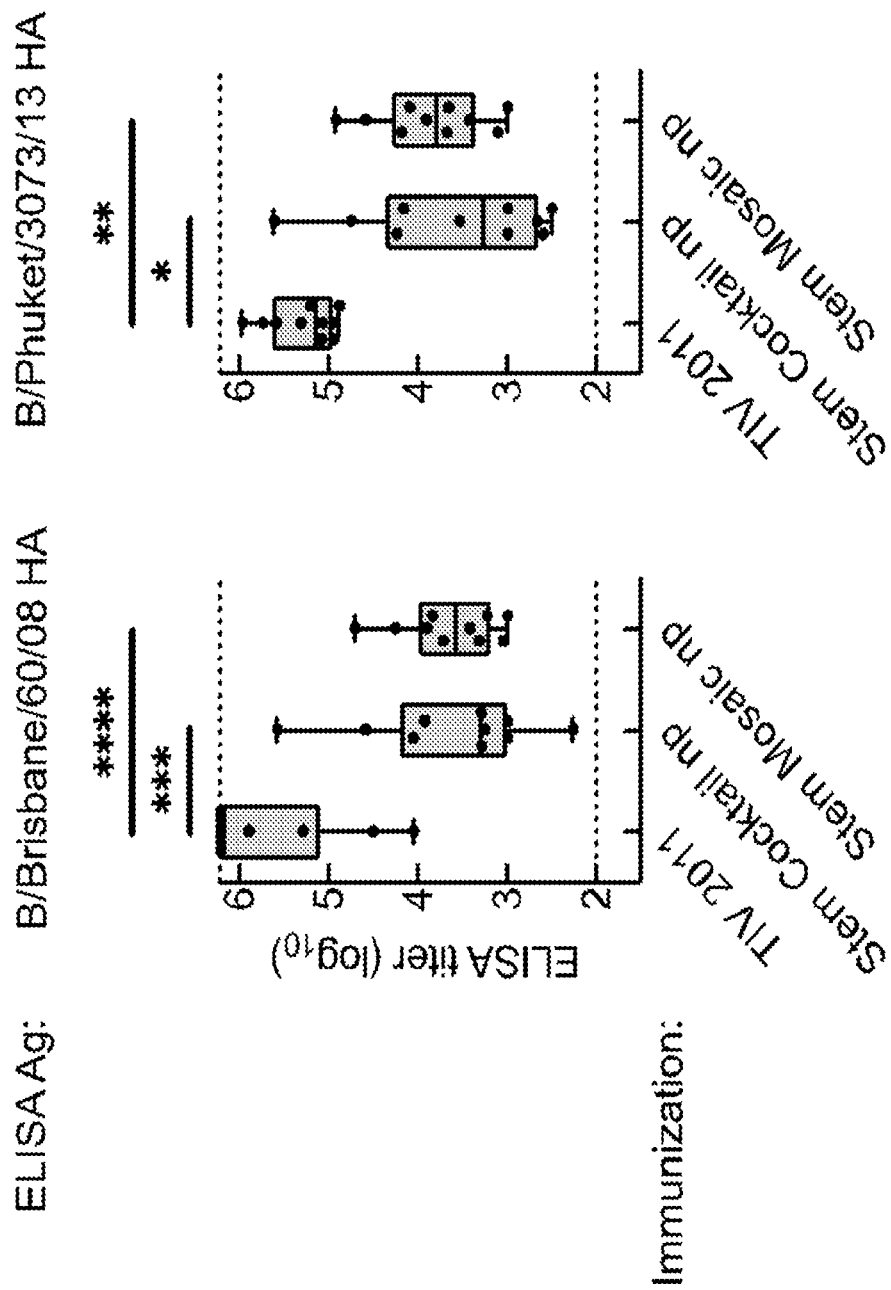

FIG. 19 shows HA-binding antibody titer to influenza B virus HA in mice immunized with 6 μg of the commercial TIV 2011, stem cocktail nanoparticles, or stem mosaic nanoparticles with Addavax™ adjuvant. Serum antibody titer to heterologous influenza B HAs was measured at 2 weeks after the third immunization (week 10) with Addavax™-adjuvanted immunogens by ELISA. In this figure, each Dot represents endpoint titer of each mouse (N=10); each Box indicates upper and lower quartiles and whiskers indicate highest and lowest data points in each dataset; Median is shown as a line in each box.

Figure 20A:
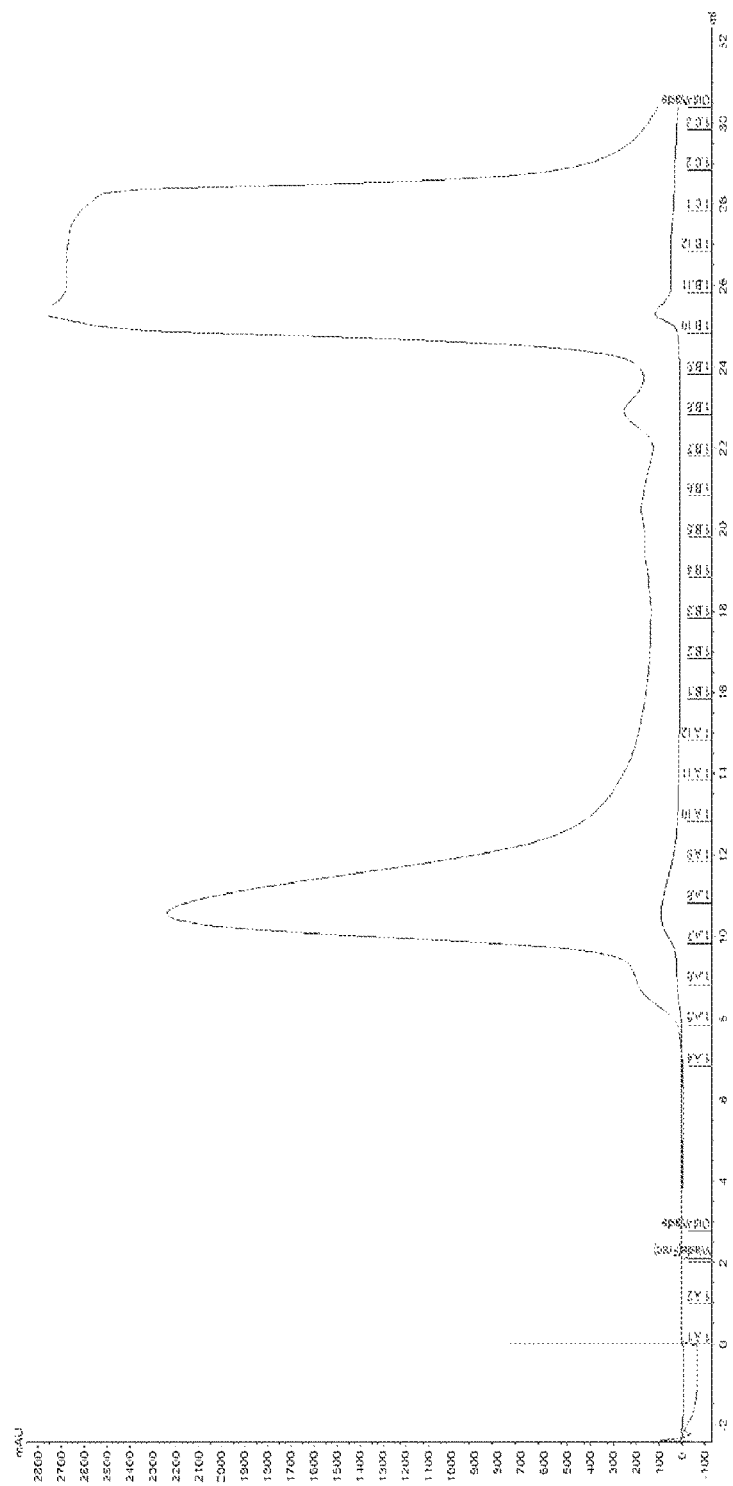
Figure 20B:
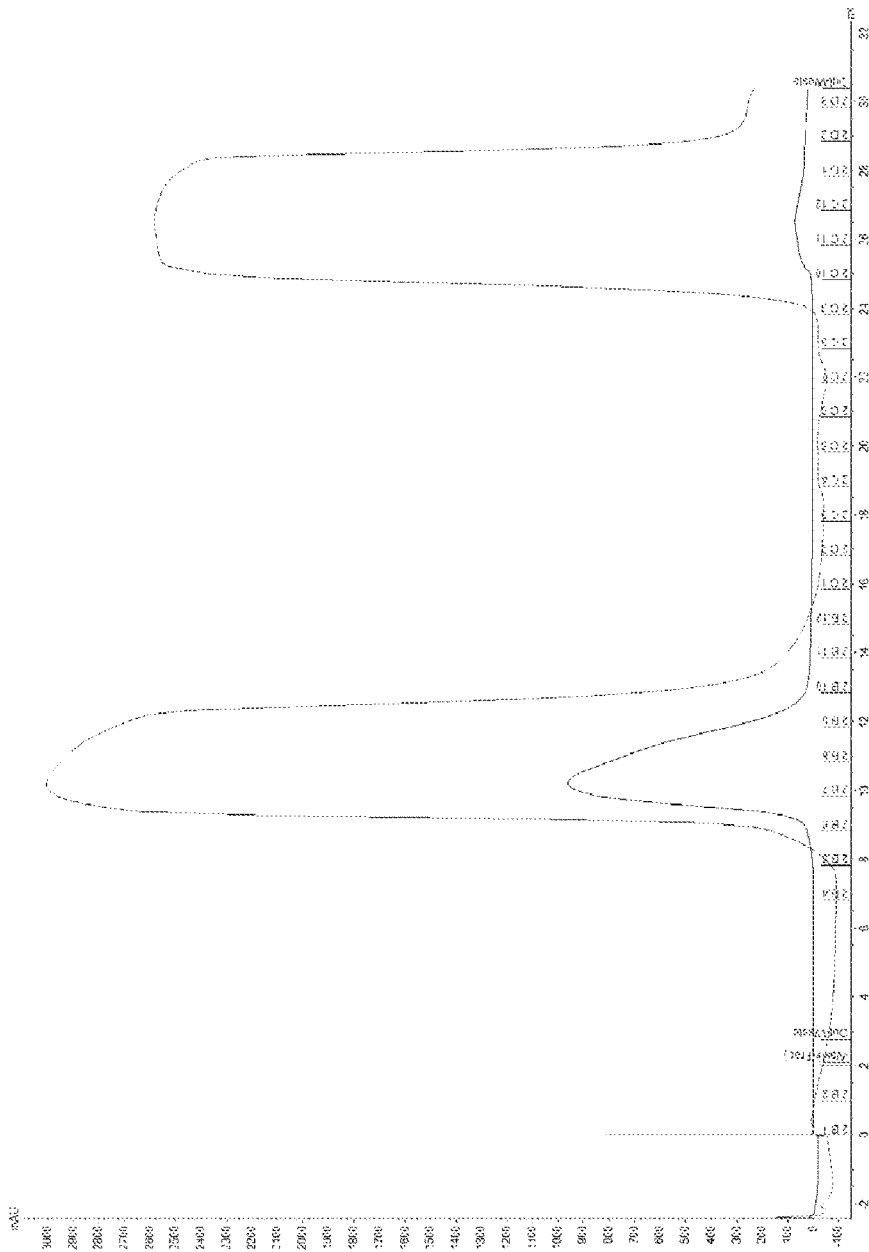

FIGS. 20A and 20B show SEC profiles that demonstrate increased expression of I53-dn5 A.1 (LF4_W16G) (FIG. 20B) compared with the original I53-dn5 A (FIG. 20A), which is provided by removal of cysteines and addition of other mutations. Both proteins were expressed in 1 L of E. coli culture and purified by nickel-affinity chromatography prior to SEC on Superdex™ 75 Increase 10/300 column (GE Healthcare).

Figure 21A:
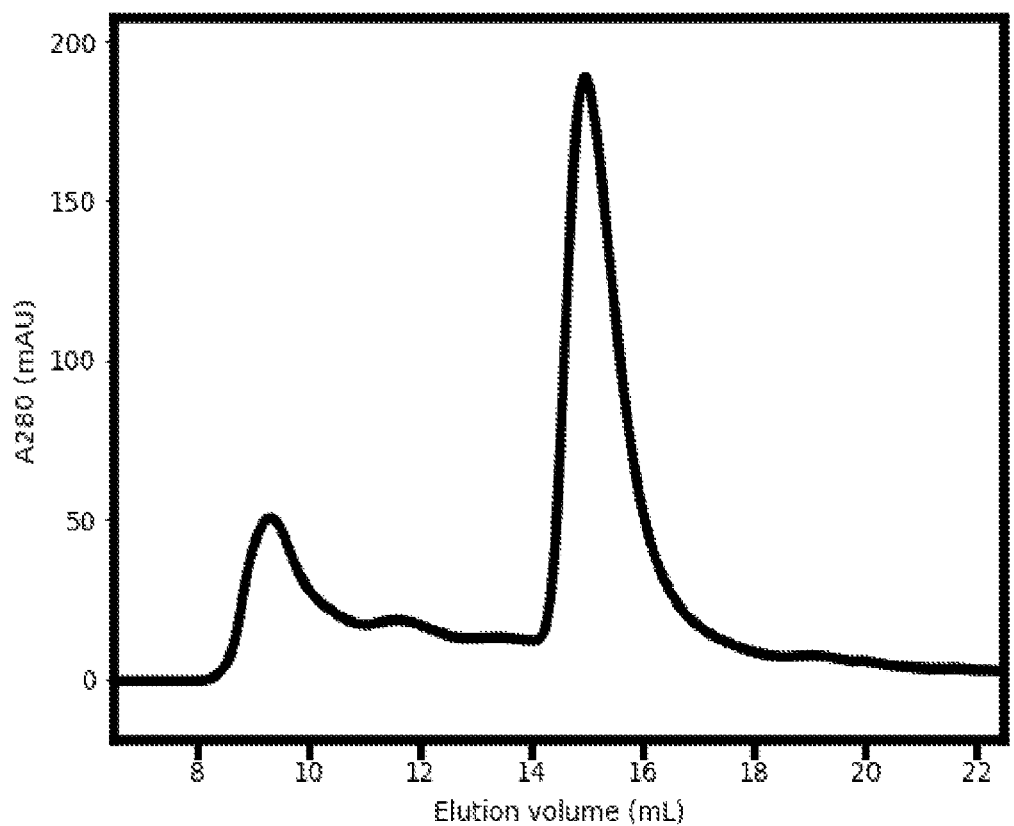
Figure 21B:
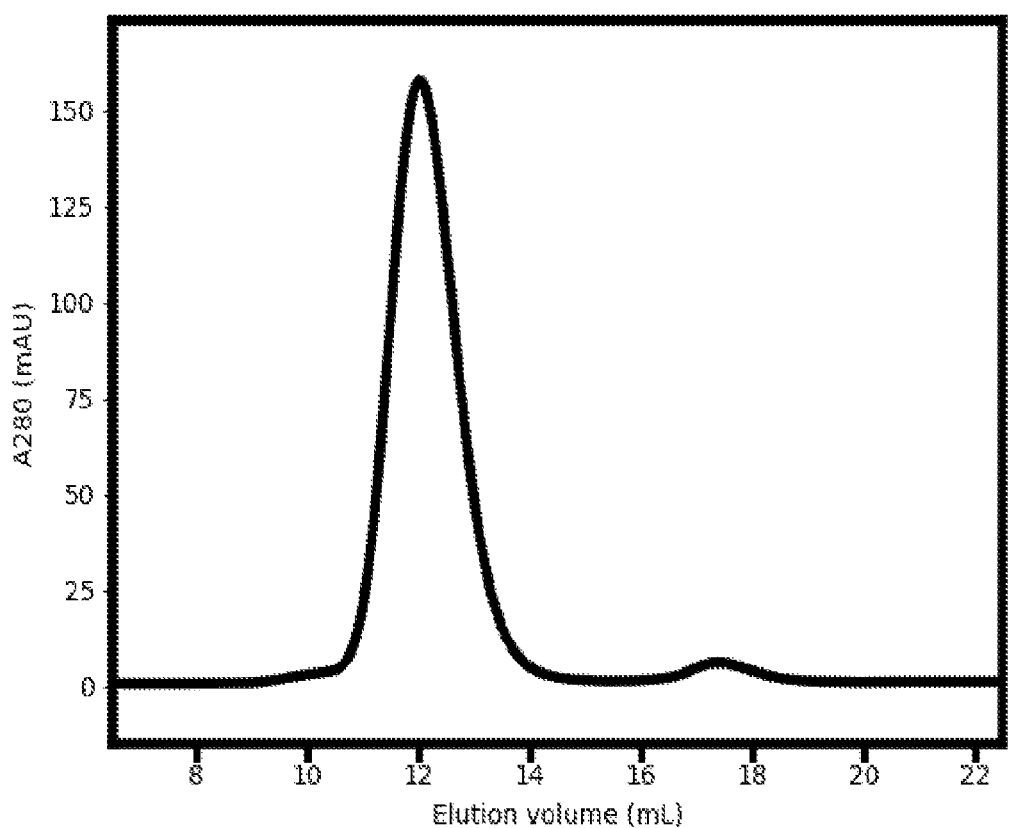
Figure 21C:
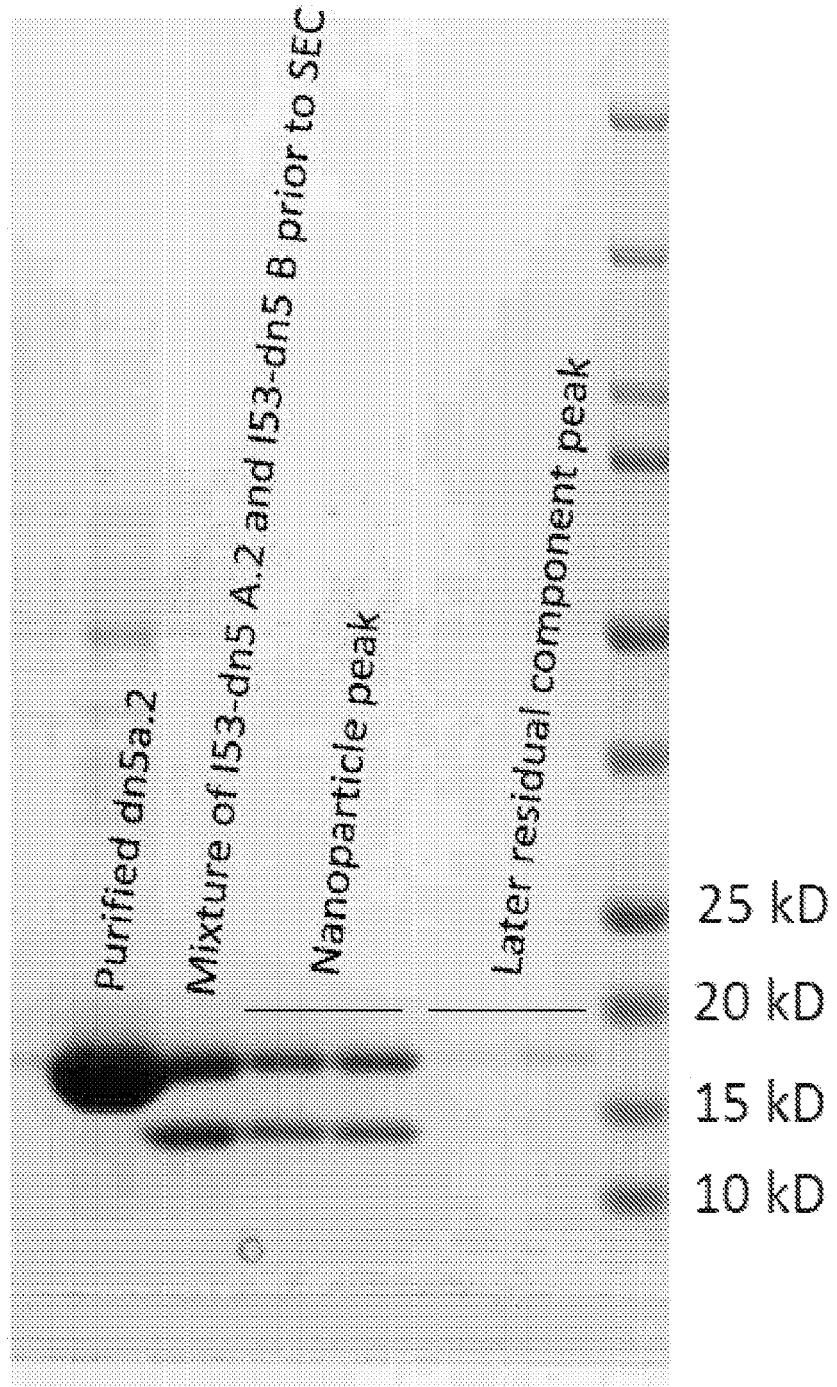

FIGS. 21A, 21B, and 21C show purification and assembly of I53-dn5 A2 (LF2_W16G_LS) pentameric component that was secreted from HEK293F mammalian cell culture. After expression and purification from cell supernatant by nickel-affinity chromatography, SEC of secreted I53-dn5 A.2 pentameric component on a Superdex™ 200 Increase 10/300 column (GE Healthcare) demonstrated correct size (FIG. 21A). Mixing the SEC-purified I53-dn5 A.2 with I53-dn5 B trimer successfully assembled nanoparticles which were validated by SEC on a Superose™ 6 Increase 10/300 column (GE Healthcare) (FIG. 21 B). Correct identity of proteins at all steps was confirmed by SDS-PAGE (FIG. 21C).

For FIGS. 2A-2D, 3A, 3B, 4, 5A-5B, 8A, 8B, 9, 13, 14, 15, 16A, 16B, 17, 18A, 18B, 19, statistical analysis was conducted by nonparametric Kruskal-Wallis test with Dunn's post-hoc multiple comparisons, and * indicates $p<0.05$;  indicates $p<0.01$; * indicates $p<0.001$; **** indicates $p<0.0001$.

DETAILED DESCRIPTION

This disclosure relates to nanoparticles, and nanoparticle-based vaccines, that elicit an immune response against hemagglutinin (HA) proteins from a broad range of influenza viruses. These vaccines contain self-assembling nanoparticles that display immunogenic portions of the influenza virus HA protein on their surface. The nanoparticles comprise two unique assemblies that non-covalently interact to form the nanoparticle. The assemblies comprise synthetic proteins that have been designed to self-assemble into a nanoparticle, with the synthetic proteins (building blocks) arranged in three-dimensions according to a particular mathematical symmetry group. In these nanoparticles, at least some of the assemblies comprise a self-assembling protein joined to an immunogenic portion of an influenza virus HA protein, such that the immunogenic portion of the HA protein is displayed on the surface of the nanoparticle. Such nanoparticles are useful, for example, for vaccinating subjects against influenza virus, and for detecting anti-influenza antibodies or influenza-specific B cells. This disclosure also relates to proteins, including fusion proteins, for producing such nanoparticles, and nucleic acid molecules encoding such proteins. Additionally, this disclosure relates to methods of producing nanoparticles of this disclosure, and methods of using such nanoparticles to vaccinate subjects.

The terminology used herein is for the purpose of describing particular embodiments only and is not intended to be limiting, since the scope of this disclosure will be limited only by the claims.

As used herein and in the appended claims, the singular forms "a," "an," and "the" include plural referents unless the context clearly dictates otherwise. For example, a nucleic acid molecule refers to one or more nucleic acid molecules. As such, the terms "a", "an", "one or more" and "at least one" can be used interchangeably. Similarly, the terms "comprising", "including" and "having" can be used interchangeably. It is further noted that the claims may be drafted to exclude any optional element. As such, this statement is intended to serve as antecedent basis for use of such exclusive terminology as "solely," "only" and the like in connection with the recitation of claim elements or use of a "negative" limitation.

Unless defined otherwise, all technical and scientific terms used herein have the same meaning as commonly understood by one of ordinary skill in the art to which this invention belongs. Although any methods and materials similar or equivalent to those described herein can also be used in the practice or testing of this disclosure, the preferred methods and materials are now described.

Nanoparticles of this disclosure comprise: 1) a plurality of first assemblies composed of a plurality of identical first proteins; and 2) a plurality of second assemblies composed of a plurality of identical second proteins, wherein at least one second assembly comprises a second protein joined to an immunogenic portion of an influenza hemagglutinin (HA) protein, thereby forming a fusion protein. In these nanoparticles, the sequence of the first proteins may differ from the sequence of the second protein. Additionally, the plurality of first assemblies non-covalently interact with the plurality of second assemblies to form the nanoparticle, and the nanoparticle assembled from the plurality of first and second assemblies displays the immunogenic portion of the HA protein on the exterior surface of the nanoparticle.

As used herein, a nanoparticle refers to the three-dimensional structure formed by the non-covalent interaction of the first and second assemblies of the disclosure. Nanoparticles of this disclosure can have any shape and/or symmetry suitable for an intended use, including, but not limited to, tetrahedral, octahedral, icosahedral, dodecahedral, and truncated forms thereof. Nanoparticles of this disclosure can be of any suitable size for an intended use, including but not limited to about 10 nm to about 100 nm in diameter.

Assembly of the first and second assemblies into nanoparticles of this disclosure is not random, but is dictated by non-covalent interactions (e.g., hydrogen bonds, electrostatic, Van der Waals, hydrophobic, etc.) between the various assemblies (i.e., the cumulative effect of interactions between first assemblies, interactions between second assemblies, and interactions between first and second assemblies). Consequently, nanoparticles of this disclosure comprise symmetrically repeated, non-natural, non-covalent, protein-protein interfaces that orient the first and second assemblies into a nanoparticle having a highly ordered structure. While the formation of nanoparticles is due to non-covalent interactions of the first and second assemblies, in some embodiments, once formed, nanoparticles may be stabilized by covalent linking between proteins in the first assemblies and the second assemblies. Any suitable covalent linkage may be used, including but not limited to disulfide bonds and isopeptide linkages.

As used herein, assemblies are multimeric structures resulting from non-covalent interactions of a plurality (2, 3, 4, 5, 6, or more) of self-assembling proteins (i.e., first and second proteins) of this disclosure. As such, assemblies of the disclosure can include, but are not limited to, dimers, trimers, tetramers, pentamers, hexamers, heptamers, octamers, nonamers, decamers, and the like. Non-covalent interaction of the individual self-assembling proteins results in self-assembly of the first protein into first assemblies, and self-assembly of the second proteins into second assemblies. The number of first proteins in a first assembly may be the same or different than the number of second proteins in a second assembly. Thus, for example, a nanoparticle of the disclosure may comprise a pentameric first assembly and a trimeric second assembly. While the formation of assemblies is due to non-covalent interactions of a multiplicity of self-assembling proteins, in some embodiments, once formed, assemblies may be stabilized by covalent linking of proteins within the assembly. Thus, for example, a first assembly may be stabilized by covalently cross-linking the first proteins in the first assembly.

First proteins and second proteins suitable for producing assemblies of this disclosure may be of any suitable length for a given nanoparticle. First proteins and second proteins may be between 30 and 250 amino acids in length, between 30 and 225 amino acids in length, between 30-200 amino acids in length, between 30-175 amino acids in length, between 50-250 amino acids in length, between 50-225 amino acids in length, between 50-200 amino acids in length, between 50-175 amino acids in length, between 75-250 amino acids in length, between 75-225 amino acids in length, between 75-200 amino acids in length, between 75-175 amino acids in length, between 100-250 amino acids in length, between 100-225 amino acids in length, between 100-200 amino acids in length, between 100-175 amino acids in length, between 125-250 amino acids in length, between 125-225 amino acids in length, between 125-200 amino acids in length, between 125-175 amino acids in length, between 150-250 amino acids in length, between 150-225, amino acids in length, between 150-200 amino acids in length, and between 150-175 amino acids in length.

As indicated above, first proteins of this disclosure self-assemble to form first assemblies of this disclosure. Likewise, second proteins of this disclosure self-assemble to form second self-assemblies. Self-assembly refers to the ability of a molecule, such as a protein, to interact with a plurality of identical molecules to form an ordered multimeric structure, such as a dimer, trimer, tetramer, pentamer, and the like. Accordingly, as used herein, a self-assembling protein is a protein that when incubated under appropriate conditions, non-covalently interacts with a plurality of identical, self-assembling proteins to form a multimeric, ordered structure (e.g., a first assembly, or a second assembly). The amino acid sequence of each self-assembling protein (e.g., a first protein, a second protein) in the final, multimeric assembly is identical. Thus, first assemblies of the disclosure comprise first proteins, the sequences of which are identical. Likewise, second assemblies of the disclosure comprise second proteins, the sequences of which are identical. The sequences of the first and second proteins may be different from one another.

Self-assembling proteins of this disclosure are synthetic, meaning that they are not naturally occurring. As used herein, phrases such as synthetic, not naturally occurring, non-natural, and the like, mean not found in nature. Accordingly, the sequence of the first and second proteins of the disclosure are not found in nature. Thus, such proteins and polypeptides have been designed by the hand of man using, for example, computational protein design and recombinant DNA techniques. Self-assembling proteins of this disclosure have been designed so that a plurality of identical self-assembling proteins interact to self-assemble into a multimeric assembly. There are no specific sequence requirements for the primary amino acid sequence of first or second proteins of the disclosure, with the exception that the sequence must be capable of effecting self-assembly of the protein into a multimeric assembly, such as a first or second assembly of this disclosure. Examples of such proteins are disclosed herein and in U.S. Pat. No. 9,630,994; PCT Pub. No. WO 2014/124301; and PCT Pub. No. WO 2018/187325, all of which are incorporated herein by reference in their entirety.

In various non-limiting embodiments, each first protein of the nanoparticle comprises, or consists of, an amino acid sequence at least 80%, 85%, 90%, 91%, 95%, 96%, 97%, 98%, or 99% identical, or 100% identical to the sequence of a first protein listed in Table 1 below:

TABLE 1

Exemplary nucleic acid and amino acid sequences

| SEQ ID NO. | Construct | Description | Sequence Type |
|---|---|---|---|
| 1 | A/New Caledonia/20/1999 (1999 NC, H1) | HA Ectodomain | |
| 2 | A/New Caledonia/20/1999 (1999 NC, H1) | HA Head region | |
| 3 | A/New Caledonia/20/1999 (1999 NC, H1) | HA Internal loop region + flanks | |
| 4 | A/Michigan/45/2015 (H1N1) HA 1-671 Y98F | HA Ectodomain | |
| 5 | A/Michigan/45/2015 (H1N1) HA 1-671 Y98F | HA Head region | |
| 6 | A/Michigan/45/2015 (H1N1) HA 1-671 Y98F | HA Internal loop region + flanks | |
| 7 | A/Hong_Kong/4801/2014 (H3N2) | HA Ectodomain | |
| 8 | A/Hong_Kong/4801/2014 (H3N2) | HA Head region | |
| 9 | A/Hong_Kong/4801/2014 (H3N2) | HA Internal loop region + flanks | |
| 10 | B/Brisbane/60/2008 HA | HA Ectodomain | |
| 11 | B/Brisbane/60/2008 HA | HA Head region | |
| 12 | B/Brisbane/60/2008 HA | HA Internal loop region + flanks | |
| 13 | B/Phuket/3073/2013 HA | HA Ectodomain | |
| 14 | B/Phuket/3073/2013 HA | HA Head region | |
| 15 | B/Phuket/3073/2013 HA | HA Internal loop region + Hflanks | |
| 16 | A/Singapore/1/1957 (H2N2) | HA Ectodomain | |
| 17 | A/Singapore/1/1957 (H2N2) | HA Head region | |
| 18 | A/Singapore/1/1957 (H2N2) | HA Internal loop region + flanks | |
| 19 | A/Indonesia/5/2005 (H5N1) | HA TABLE 1-continued Exemplary nucleic acid and amino acid sequences

| SEQ ID NO. | Construct | Description | Sequence Type |
|---|---|---|---|
| 56 | I53-dn5 A_LF4_W16E_LS | | Nucleic Acids |
| 57 | I53-dn5 A_LF4_W16E_LS | first protein (pentamer) | Proteins |
| 58 | I53-dn5 A_LF2_W16E_LS_RS | | Nucleic Acids |
| 59 | I53-dn5 A_LF2_W16E_LS_RS | first protein (pentamer) | Proteins |
| 60 | I53-dn5 A_LF4_W16G_RS | | Nucleic Acids |
| 63 | I53-dn5 A_LF4_W16G_RS | first protein (pentamer) | Proteins |
| 62 | I53-dn5 A_LF2_W16E | | Nucleic Acids |
| 63 | I53-dn5 A_LF2_W16E | first protein (pentamer) | Proteins |
| 64 | I53-dn5 A_LF4_W16G_LS | | Nucleic Acids |
| 65 | I53-dn5 A_LF4_W16G_LS | first protein (pentamer) | Proteins |
| 66 | I53-dn5 mIgK.A.2 (A_LF2_W16G_LS) | | Nucleic Acids |
| 67 | I53-dn5 mIgK.A.2 (A_LF2_W16G_LS) | first protein (pentamer) | Proteins |
| 68 | I53-dn5 mIgK.A_LF4_W16G_LS | | Nucleic Acids |
| 69 | I53-dn5 mIgK.A_LF4_W16G_LS | first protein (pentamer) | Proteins |
| 70 | I53-dn5 mIgK.A_LF4_W16E_LS | | Nucleic Acids |
| 71 | I53-dn5 mIgK.A_LF4_W16E_LS | first protein (pentamer) | Proteins |
| 72 | I53-dn5 mIgK.A_LF2_W16E_LS | | Nucleic Acids |
| 73 | I53-dn5 mIgK.A_LF2_W16E_LS | first protein (pentamer) | Proteins |
| 74 | I53-dn5 mIgK.A_LF2_W16E | | Nucleic Acids |
| 75 | I53-dn5 mIgK.A_LF2_W16E | first protein (pentamer) | Proteins |
| 76 | I53-dn5 mIgK.A_W16E | | Nucleic Acids |
| 77 | I53-dn5 mIgK.A_W16E | first protein (pentamer) | Proteins |
| 78 | I53-dn5 mIgK.A_LF2_W16E_LS_RS | | Nucleic Acids |
| 79 | I53-dn5 mIgK.A_LF2_W16E_LS_RS | first protein (pentamer) | Proteins |
| 80 | I53-dn5 mIgK.A_LF4_W16E_LS_RS | | Nucleic Acids |
| 81 | I53-dn5 mIgK.A_LF4_W16E_LS_RS | first protein (pentamer) | Proteins |
| 82 | I53-dn5 mIgK.A_LF4_W16G_RS | | Nucleic Acids |
| 83 | I53-dn5 mIgK.A_LF4_W16G_RS | first protein (pentamer) | Proteins |
| 84 | I53-dn5 mIgK.A_LF4_W16E | | Nucleic Acids |
| 85 | I53-dn5 mIgK.A_LF4_W16E | first protein (pentamer) | Proteins |
| 86 | I53-dn5 mIgK.A_LF2_W16G_RS | | Nucleic Acids |
| 87 | I53-dn5 mIgK.A_LF2_W16G_RS | first protein (pentamer) | Proteins |
| 88 | I53-dn5 B | | Nucleic Acids |
| 89 | I53-dn5 B | second protein (trimer) | Proteins |
| 90 | A/Michigan/45/2015 (H1N1) HA 1-671 Y98F GSGSG dn5B | | Nucleic Acids |
| 91 | A/Michigan/45/2015 (H1N1) HA 1-671 Y98F GSGSG dn5B | Second protein (trimer)/HA fusion protein | Proteins |
| 92 | A/Michigan/45/2015 (H1N1) HA 1-676 Y98F 2G dn5B.ext | | Nucleic Acids |
| 93 | A/Michigan/45/2015 (H1N1) HA 1-676 Y98F 2G dn5B.ext | Second protein (trimer)/HA fusion protein | Proteins |
| 94 | A/Michigan/45/2015 (H1N1) HA 1-676 Y98F 2PG dn5B.ext | | Nucleic Acids |
| 95 | A/Michigan/45/2015 (H1N1) HA 1-676 Y98F 2PG dn5B.ext | Second protein (trimer)/HA fusion protein | Proteins |
| 96 | A/Michigan/45/2015 (H1N1) HA 1-676F Y98F 2PG dn5B.ext | | Nucleic Acids |
| 97 | A/Michigan/45/2015 (H1N1) HA 1-676F Y98F 2PG dn5B.ext | Second protein (trimer)/HA fusion protein | Proteins |
| 98 | A/Michigan/45/2015 (H1N1) HA 1-676I Y98F 2PG dn5B.ext | | Nucleic Acids |
| 99 | A/Michigan/45/2015 (H1N1) HA 1-676I Y98F 2PG dn5B.ext | Second protein (trimer)/HA fusion protein | Proteins |
| 100 | A/Michigan/45/2015 (H1N1) HA 1-676W Y98F 2PG dn5B.ext | | Nucleic Acids |
| 101 | A/Michigan/45/2015 (H1N1) HA 1-676W Y98F 2PG dn5B.ext | Second protein (trimer)/HA fusion protein | Proteins |
| 102 | A/Michigan/45/2015 (H1N1) HA 1-676 Y98F no_lkr_dn5B.SA | | Nucleic Acids |
| 103 | A/Michigan/45/2015 (H1N1) HA 1-676 Y98F no_lkr_dn5B.SA | Second protein (trimer)/HA fusion protein | Proteins |
| 104 | A/Michigan/45/2015 (H1N1) HA 1-676 Y98F no_lkr_dn5B.KA | | Nucleic Acids |
| 105 | A/Michigan/45/2015 (H1N1) HA 1-676 Y98F no_lkr_dn5B.KA | Second protein (trimer)/HA fusion protein | Proteins |
| 106 | A/Michigan/45/2015 (H1N1) HA 1-676 Y98F no_lkr_dn5B.RA | | Nucleic Acids |
| 107 | A/Michigan/45/2015 (H1N1) HA 1-676 Y98F no_lkr_dn5B.RA | Second protein (trimer)/HA fusion protein | Proteins |
| 108 | A/Michigan/45/2015 (H1N1) HA 1-676F Y98F no_lkr_dn5B.SA | | Nucleic Acids |
| 109 | A/Michigan/45/2015 (H1N1) HA 1-676F Y98F no_lkr_dn5B.SA | Second protein (trimer)/HA fusion protein | Proteins |

TABLE 1-continued

| Exemplary nucleic acid and amino acid sequences | | | |
|---|---|---|---|
| SEQ ID NO. | Construct | Description | Sequence Type |
| 110 | A/Michigan/45/2015 (H1N1) HA 1-676F Y98F no_lkr_dn5B.KA | | Nucleic Acids |
| 111 | A/Michigan/45/2015 (H1N1) HA 1-676F Y98F no_lkr_dn5B.KA | Second protein (trimer)/HA fusion protein | Proteins |
| 112 | A/Michigan/45/2015 (H1N1) HA 1-676F Y98F no_lkr_dn5B.RA | | Nucleic Acids |
| 113 | A/Michigan/45/2015 (H1N1) HA 1-676F Y98F no_lkr_dn5B.RA | Second protein (trimer)/HA fusion protein | Proteins |
| 114 | A/Hong_Kong/4801/2014 (H3N2) HA 1-672 Y98F GSGSG dn5B | | Nucleic Acids |
| 115 | A/Hong_Kong/4801/2014 (H3N2) HA 1-672 Y98F GSGSG dn5B | Second protein (trimer)/HA fusion protein | Proteins |
| 116 | A/Hong_Kong/4801/2014 (H3N2) HA 1-671 Y98F G2PG dn5B.ext | | Nucleic Acids |
| 117 | A/Hong_Kong/4801/2014 (H3N2) HA 1-671 Y98F G2PG dn5B.ext | Second protein (trimer)/HA fusion protein | Proteins |
| 118 | A/Hong_Kong/4801/2014 (H3N2) HA 1-672 Y98F G2PG dn5B.ext | | Nucleic Acids |
| 119 | A/Hong_Kong/4801/2014 (H3N2) HA 1-672 Y98F G2PG dn5B.ext | Second protein (trimer)/HA fusion protein | Proteins |
| 120 | A/Hong_Kong/4801/2014 (H3N2) HA 1-673 Y98F 2PG dn5B.ext | | Nucleic Acids |
| 121 | A/Hong_Kong/4801/2014 (H3N2) HA 1-673 Y98F 2PG dn5B.ext | Second protein (trimer)/HA fusion protein | Proteins |
| 122 | A/Hong_Kong/4801/2014 (H3N2) HA 1-676 Y98F no lkr dn5B.SA. | | Nucleic Acids |
| 123 | A/Hong_Kong/4801/2014 (H3N2) HA 1-676 Y98F no lkr dn5B.SA. | Second protein (trimer)/HA fusion protein | Proteins |
| 124 | A/Hong_Kong/4801/2014 (H3N2) HA 1-676 Y98F H7sig-DK no lkr dn5B.SA | | Nucleic Acids |
| 125 | A/Hong_Kong/4801/2014 (H3N2) HA 1-676 Y98F H7sig-DK no lkr dn5B.SA. | Second protein (trimer)/HA fusion protein | Proteins |
| 126 | A/Hong_Kong/4801/2014 (H3N2) HA 1-676 Y98F GG lkr dn5B.SA | | Nucleic Acids |
| 127 | A/Hong_Kong/4801/2014 (H3N2) HA 1-676 Y98F GG lkr dn5B.SA | Second protein (trimer)/HA fusion protein | Proteins |
| 128 | B/Brisbane/60/2008 HA 1-674 no lkr dn5B.SA | | Nucleic Acids |
| 129 | B/Brisbane/60/2008 HA 1-674 no lkr dn5B.SA | Second protein (trimer)/HA fusion protein | Proteins |
| 130 | B/Brisbane/60/2008 HA 1-676 no lkr dn5B.SA | | Nucleic Acids |
| 131 | B/Brisbane/60/2008 HA 1-676 no lkr dn5B.SA | Second protein (trimer)/HA fusion protein | Proteins |
| 132 | B/Phuket/3073/2013 HA 1-674 no lkr dn5B.SA | | Nucleic Acids |
| 133 | B/Phuket/3073/2013 HA 1-674 no lkr dn5B.SA.WLEQ-H | Second protein (trimer)/HA fusion protein | Proteins |
| 134 | B/Phuket/3073/2013 HA 1-676 no lkr dn5B.SA | | Nucleic Acids |
| 135 | B/Phuket/3073/2013 HA 1-676 no lkr dn5B.SA | Second protein (trimer)/HA fusion protein | Proteins |
| 136 | A/Singapore/1/1957 (H2N2) 1-676 Y98F no lkr dn5B.SA | | Nucleic Acids |
| 137 | A/Singapore/1/1957 (H2N2) 1-676 Y98F no lkr dn5B.SA | Second protein (trimer)/HA fusion protein | Proteins |
| 138 | A/Indonesia/5/2005 (H5N1) 1-676 delF Y98F no lkr dn5B.SA | | Nucleic Acids |
| 139 | A/Indonesia/5/2005 (H5N1) 1-676 delF Y98F no lkr dn5B.SA | Second protein (trimer)/HA fusion protein | Proteins |
| 140 | A/Taiwan/2/2013 (H6N1) HA 1-676 Y98F no lkr dn5B.SA | | Nucleic acids |
| 141 | A/Taiwan/2/2013 (H6N1) HA 1-676 Y98F no lkr dn5B.SA | Second protein (trimer)/HA fusion protein | Proteins |
| 142 | A/Anhui/1/2013 (H7N9) HA 1-676 Y98F no lkr dn5B.SA | | Nucleic acids |
| 143 | A/Anhui/1/2013 (H7N9) HA 1-676 Y98F no lkr dn5B.SA | Second protein (trimer)/HA fusion protein | Proteins |
| 144 | A/Anhui/1/2013 (H7N9) HA 1-676 Y98F GG lkr dn5B.SA | | Nucleic acids |
| 145 | A/Anhui/1/2013 (H7N9) HA 1-676 Y98F GG lkr dn5B.SA | Second protein (trimer)/HA fusion protein | Proteins |
| 146 | A/Hong_Kong/33982/2009 (H9N2) HA 1-676 Y98F no lkr dn5B.SA | | Nucleic acids |
| 147 | A/Hong_Kong/33982/2009 (H9N2) HA 1-676 Y98F no lkr dn5B.SA | Second protein (trimer)/HA fusion protein | Proteins |
| 148 | A/Jiangxi-Donghun/346/2013 (H10N8) HA 1-676 Y98F no lkr dn5B.SA | | Nucleic acids |

TABLE 1-continued

Exemplary nucleic acid and amino acid sequences

| SEQ ID NO. | Construct | Description | Sequence Type |
|---|---|---|---|
| 149 | A/Jiangxi-Donghu/346/2013 (H10N8) HA 1-676 Y98F no lkr dn5B.SA | Second protein (trimer)/HA fusion protein | Proteins |
| 150 | A/Singapore/INFIMH-16-0019/2016 HA 1-676 Y98F GG lkr dn5B.SA | | Nucleic acids |
| 151 | A/Singapore/INFIMH-16-0019/2016 HA 1-676 Y98F GG lkr dn5B.SA | Second protein (trimer)/HA fusion protein | Proteins |
| 152 | B/Colorado/06/2017 HA 1-674 no lkr dn5B.SA | | Nucleic acids |
| 153 | B/Colorado/06/2017 HA 1-674 no lkr dn5B.SA | Second protein (trimer)/HA fusion protein | Proteins |
| 154 | A/New Caledonia/20/1999 (H1N1) 1-676 Y98F no_lkr_dn5B.SA | | Nucleic acids |
| 155 | A/New Caledonia/20/1999 (H1N1) 1-676 Y98F no_lkr_dn5B.SA | Second protein (trimer)/HA fusion protein | Proteins |
| 156 | A/Soloman Islands/03/2006 (H1N1) 1-676 Y98F no_lkr_dnSB.SA | | Nucleic acids |
| 157 | A/Soloman Islands/03/2006 (H1N1) 1-676 Y98F no_lkr_dn5B.SA | Second protein (trimer)/HA fusion protein | Proteins |
| 158 | B/Brisbane/60/2008 HA 1-674 no lkr dn5B-NT1.SA | | Nucleic acids |
| 159 | B/Brisbane/60/2008 HA 1-674 no lkr dn5B-NT1.SA | Second protein (trimer)/HA fusion protein | Proteins |
| 160 | B/Brisbane/60/2008 HA 1-674 no lkr dn5B-NT2.SA | | Nucleic acids |
| 161 | B/Brisbane/60/2008 HA 1-674 no lkr dn5B-NT2.SA | Second protein (trimer)/HA fusion protein | Proteins |
| 162 | B/Brisbane/60/2008 HA 1-674 no lkr dn5B-PT1.SA | | Nucleic acids |
| 163 | B/Brisbane/60/2008 HA 1-674 no lkr dn5B-PT1.SA | Second protein (trimer)/HA fusion protein | Proteins |
| 164 | B/Brisbane/60/2008 HA 1-674 no lkr dn5B-PT2.SA | | Nucleic acids |
| 165 | B/Brisbane/60/2008 HA 1-674 no lkr dn5B-PT2.SA | Second protein (trimer)/HA fusion protein | Proteins |
| 166 | B/Brisbane/60/2008 HA 1-674 no lkr dn5B-PT3.SA | | Nucleic acids |
| 167 | B/Brisbane/60/2008 HA 1-674 no lkr dn5B-PT3.SA | Second protein (trimer)/HA fusion protein | Proteins |
| 168 | B/Phuket/3073/2013 HA 1-674 no lkr dn5B-NT1.SA | | Nucleic acids |
| 169 | B/Phuket/3073/2013 HA 1-674 no lkr dn5B-NT1.SA | Second protein (trimer)/HA fusion protein | Proteins |
| 170 | B/Phuket/3073/2013 HA 1-674 no lkr dn5B-NT2.SA | | Nucleic acids |
| 171 | B/Phuket/3073/2013 HA 1-674 no lkr dn5B-NT2.SA | Second protein (trimer)/HA fusion protein | Proteins |
| 172 | B/Phuket/3073/2013 HA 1-674 no lkr dn5B-PT1.SA | | Nucleic acids |
| 173 | B/Phuket/3073/2013 HA 1-674 no lkr dn5B-PT1.SA | Second protein (trimer)/HA fusion protein | Proteins |
| 174 | B/Phuket/3073/2013 HA 1-674 no lkr dn5B-PT2.SA | | Nucleic acids |
| 175 | B/Phuket/3073/2013 HA 1-674 no lkr dn5B-PT2.SA | Second protein (trimer)/HA fusion protein | Proteins |
| 176 | B/Phuket/3073/2013 HA 1-674 no lkr dn5B-PT3.SA | | Nucleic acids |
| 177 | B/Phuket/3073/2013 HA 1-674 no lkr dn5B-PT3.SA | Second protein (trimer)/HA fusion protein | Proteins |
| 178 | B/Colorado/06/2017 HA 1-674 no lkr dn5B-NT1.SA | | Nucleic acids |
| 179 | B/Colorado/06/2017 HA 1-674 no lkr dn5B-NT1.SA | Second protein (trimer)/HA fusion protein | Proteins |
| 180 | B/Colorado/06/2017 HA 1-674 no lkr dn5B-NT2.SA | | Nucleic acids |
| 181 | B/Colorado/06/2017 HA 1-674 no lkr dn5B-NT2.SA | Second protein (trimer)/HA fusion protein | Proteins |
| 182 | B/Colorado/06/2017 HA 1-674 no lkr dn5B-PT1.SA | | Nucleic acids |
| 183 | B/Colorado/06/2017 HA 1-674 no lkr dn5B-PT1.SA | Second protein (trimer)/HA fusion protein | Proteins |
| 184 | B/Colorado/06/2017 HA 1-674 no lkr dn5B-PT2.SA | | Nucleic acids |
| 185 | B/Colorado/06/2017 HA 1-674 no lkr dn5B-PT2.SA | Second protein (trimer)/HA fusion protein | Proteins |
| 186 | B/Colorado/06/2017 HA 1-674 no lkr dnSB-PT3.SA | | Nucleic acids |
| 187 | B/Colorado/06/2017 HA 1-674 no lkr dn5B-PT3.SA | Second protein (trimer)/HA fusion protein | Proteins |
| 188 | A/Michigan/45/2015 (H1N1) SS rpk22 676 no_lkr_dn5B.SA | | Nucleic acids |
| 189 | A/Michigan/45/2015 (H1N1) SS rpk22 676 no_lkr_dn5B.SA | Second protein (trimer)/HA stabilized stem (SS) fusion protein | Proteins |
| 190 | A/Michigan/45/2015 (H1N1) SS rpk22 676 no_lkr_dn5B.KA | | Nucleic acids |
| 191 | A/Michigan/45/2015 (H1N1) SS rpk22 676 no_lkr_dn5B.KA | Second protein (trimer)/HA stabilized stem (SS) fusion protein | Proteins |
| 192 | A/Michigan/45/2015 (H1N1) SS rpk22 676 no_lkr_dn5B.RA | | Nucleic acids |

TABLE 1-continued

Exemplary nucleic acid and amino acid sequences

| SEQ ID NO. | Construct | Description | Sequence Type |
|---|---|---|---|
| 193 | A/Michigan/45/2015 (H1N1) SS rpk22 676 no_lkr_dn5B.RA | Second protein (trimer)/HA stabilized stem (SS) fusion protein | Proteins |
| 194 | A/Michigan/45/2015 (H1N1) SS rpk22 676F no_lkr_dn5B.SA | | Nucleic acids |
| 195 | A/Michigan/45/2015 (H1N1) SS rpk22 676F no_lkr_dn5B.SA | Second protein (trimer)/HA stabilized stem (SS) fusion protein | Proteins |
| 196 | A/Michigan/45/2015 (H1N1) SS rpk22 676F no_lkr_dn5B.KA | | Nucleic acids |
| 197 | A/Michigan/45/2015 (H1N1) SS rpk22 676F no_lkr_dn5B.KA | Second protein (trimer)/HA stabilized stem (SS) fusion protein | Proteins |
| 198 | A/Michigan/45/2015 (H1N1) SS rpk22 676F no_lkr_dn5B.RA | | Nucleic acids |
| 199 | A/Michigan/45/2015 (H1N1) SS rpk22 676F no_lkr_dn5B.RA | Second protein (trimer)/HA stabilized stem (SS) fusion protein | Proteins |
| 200 | A/Michigan/45/2015 (H1N1) SS rpk22 QRET 676 no lkr dn5B.SA | | Nucleic acids |
| 201 | A/Michigan/45/2015 (H1N1) SS rpk22 QRET 676 no lkr dn5B.SA | Second protein (trimer)/HA stabilized stem (SS) fusion protein | Proteins |
| 202 | A/New Caledonia/20/1999 (H1N1) SS rpk22 676 dn5B.SA | | Nucleic acids |
| 203 | A/New Caledonia/20/1999 (H1N1) SS rpk22 676 dn5B.SA | Second protein (trimer)/HA stabilized stem (SS) fusion protein | Proteins |
| 204 | A/New Caledonia/20/1999 (H1N1) SS rpk22 QRET 676 dn5B.SA | | Nucleic acids |
| 205 | A/New Caledonia/20/1999 (H1N1) SS rpk22 QRET 676 dn5B.SA | Second protein (trimer)/HA stabilized stem (SS) fusion protein | Proteins |
| 206 | A/USSR/90/1977 (H1N1) SS rpk22 676 no lkr dn5B.SA | | Nucleic acids |
| 207 | A/USSR/90/1977 (H1N1) SS rpk22 676 no lkr dn5B.SA | Second protein (trimer)/HA stabilized stem (SS) fusion protein | Proteins |
| 208 | A/Brevig_Mission/1/1918 (H1N1) SS rpk22 676 no lkr dn5B.SA | | Nucleic acids |
| 209 | A/Brevig_Mission/1/1918 (H1N1) SS rpk22 676 no lkr dn5B.SA | Second protein (trimer)/HA stabilized stem (SS) fusion protein | Proteins |
| 210 | A/Singapore/1/1957 (H2N2) SS rpk22 676 no_lkr_dnSB.SA | | Nucleic acids |
| 211 | A/Singapore/1/1957 (H2N2) SS rpk22 676 no_lkr_dn5B.SA | Second protein (trimer)/HA stabilized stem (SS) fusion protein | Proteins |
| 212 | A/Hong_Kong/4801/2014 (H3N2) SS no256 676 DK no lkr dn5B.SA | | Nucleic acids |
| 213 | A/Hong_Kong/4801/2014 (H3N2) SS no256 676 DK no lkr dn5B.SA | Second protein (trimer)/HA stabilized stem (SS) fusion protein | Proteins |
| 214 | A/Hong_Kong/4801/2014 (H3N2) SS no256 676 DK no lkr dn5B.SA | | Nucleic acids |
| 215 | A/Hong_Kong/4801/2014 (H3N2) SS no256 676 DK no lkr dn5B.SA | Second protein (trimer)/HA stabilized stem (SS) fusion protein | Proteins |
| 216 | A/Indonesia/5/2005 (H5N1) delF SS rpk22 676 no_lkr_dn5B.SA | | Nucleic acids |
| 217 | A/Indonesia/5/2005 (H5N1) delF SS rpk22 676 no_lkr_dn5B.SA | Second protein (trimer)/HA stabilized stem (SS) fusion protein | Proteins |
| 218 | A/Taiwan/2/2013 (H6N1) SS rpk22 676 no lkr dn5B.SA | tri | Nucleic acids |
| 219 | A/Taiwan/2/2013 (H6NI) SS rpk22 676 no lkr dn5B.SA | Second protein (trimer)/HA stabilized stem (SS) fusion protein | Proteins |
| 220 | A/Anhui/1/2013 (H7N9) SS no256 676 no lkr dn5B.SA | | Nucleic acids |
| 221 | A/Anhui/1/2013 (H7N9) SS no256 676 no lkr dn5B.SA | Second protein (trimer)/HA stabilized stem (SS) fusion protein | Proteins |
| 222 | A/Hong_Kong/33982/2009 (H9N2) SS rpk22 676 no lkr dn5B.SA | | Nucleic acids |

TABLE 1-continued

| SEQ ID NO. | Construct | Description | Sequence Type |
|---|---|---|---|
| Exemplary nucleic acid and amino acid sequences | | | |
| 223 | A/Hong_Kong/33982/2009 (H9N2) SS rpk22 676 no lkr dn5B.SA | Second protein (trimer)/HA stabilized stem (SS) fusion protein | Proteins |
| 224 | A/Jiangxi-Donghu/346/2013 (H10N8) SS no256 676 no lkr dn5B.SA | | Nucleic acids |
| 225 | A/Jiangxi-Donghu/346/2013 (H10N8) SS no256 676 no lkr dn5B.SA | Second protein (trimer)/HA stabilized stem (SS) fusion protein | Proteins |
| 226 | I53-50 B.4PT1 | | Nucleic acids |
| 227 | I53-50 B.4PT1 | First protein (pentamer) | Proteins |
| 228 | I53-50 B | | Nucleic acids |
| 229 | I53-50 B | First protein (pentamer) | Proteins |
| 230 | I53-50 B.1 | | Nucleic acids |
| 231 | I53-50 B.1 | First protein (pentamer) | Proteins |
| 232 | I53-50 B.1NT1 | | Nucleic acids |
| 233 | I53-50 B.1NT1 | First protein (pentamer) | Proteins |
| 234 | I53-50 B.1NT2 | | Nucleic acids |
| 235 | I53-50 B.1NT2 | First protein (pentamer) | Proteins |
| 236 | I53-50 B.2PT2 | | Nucleic acids |
| 237 | I53-50 B.2PT2 | First protein (pentamer) | Proteins |
| 238 | I53-50 B.3 | | Nucleic acids |
| 239 | I53-50 B.3 | First protein (pentamer) | Proteins |
| 240 | I53-50 B.3PT1 | | Nucleic acids |
| 241 | I53-50 B.3PT1 | First protein (pentamer) | Proteins |
| 242 | I53-50 B-v4 | | Nucleic acids |
| 243 | I53-50 B-v4 | First protein (pentamer) | Proteins |
| 244 | I53-50 A.1-Nhe | | Nucleic acids |
| 245 | I53-50 A.1-Nhe | second protein (trimer) | Proteins |
| 246 | I53-50 A.1NT2-Nhe | | Nucleic acids |
| 247 | I53-50 A.1NT2-Nhe | second protein (trimer) | Proteins |
| 248 | I53-50 A-Nhe | | Nucleic acids |
| 249 | I53-50 A-Nhe | second protein (trimer) | Proteins |
| 250 | I53-50 A.1NT1-Nhe | | Nucleic acids |
| 251 | I53-50 A.1NT1-Nhe | second protein (trimer) | Proteins |
| 252 | I53-50 A.1PT1-Nhe | | Nucleic acids |
| 253 | I53-50 A.1PT1-Nhe | second protein (trimer) | Proteins |
| 254 | I53-50 A.1PT2-Nhe | | Nucleic acids |
| 255 | I53-50 A.1PT2-Nhe | second protein (trimer) | Proteins |
| 256 | I53-50 A-v4-Nhe | | Nucleic acids |
| 257 | I53-50 A-v4-Nhe | second protein (trimer) | Proteins |
| 258 | A/Michigan/45/2015 (H1N1) HA 1-671 Y98F 8GS 50A1 | | Nucleic acids |
| 259 | A/Michigan/45/2015 (H1N1) HA 1-671 Y98F 8GS 50A1 | Second protein (trimer)/HA fusion protein | Proteins |
| 260 | A/Michigan/45/2015 (H1N1) HA 1-671 Y98F 8GS 50A1NT2 | | Nucleic acids |
| 261 | A/Michigan/45/2015 (H1N1) HA 1-671 Y98F 8GS 50A1NT2 | Second protein (trimer)/HA fusion protein | Proteins |
| 262 | A/Hong_Kong/4801/2014 (H3N2) HA 1-672 Y98F 8GS 50A1 | | Nucleic acids |
| 263 | A/Hong_Kong/4801/2014 (H3N2) HA 1-672 Y98F 8GS 50A1 | Second protein (trimer)/HA fusion protein | Proteins |
| 264 | A/Hong_Kong/4801/2014 (H3N2) HA 1-672 Y98F 8GS 50A1NT2 | | Nucleic acids |
| 265 | A/Hong_Kong/4801/2014 (H3N2) HA 1-672 Y98F 8GS 50A1NT2 | Second protein (trimer)/HA fusion protein | Proteins |
| 266 | I53-34A | Second protein (trimer) | |
| 267 | I53-34B | First protein (pentamer) | |
| 268 | I53-40A | First protein (pentamer) | |
| 269 | I53-40B | Second protein (trimer) | |
| 270 | I53-47A | Second protein (trimer) | |
| 271 | I53-47B | First protein (pentamer) | |
| 272 | I53-50A | Second protein (trimer) | |
| 273 | I53-50B | First protein (pentamer) | |
| 274 | I53-51A | Second protein (trimer) | |
| 275 | I53-51B | First protein (pentamer) | |
| 276 | I52-03A | First protein (pentamer) | |
| 277 | I52-03B | Second protein (dimer) | |
| 278 | I52-32A | Second protein (dimer) | |
| 279 | I52-32B | First protein (pentamer) | |
| 280 | I52-33A | First protein (pentamer) | |
| 281 | I52-33B | Second protein (dimer) | |
| 282 | I32-06A | First protein (dimer) | |
| 283 | I32-06B | Second protein (trimer) | |
| 284 | I32-19A | Second protein (trimer) | |

TABLE 1-continued

Exemplary nucleic acid and amino acid sequences

| SEQ ID NO. | Construct | Description | Sequence Type |
|---|---|---|---|
| 285 | I32-19B | First protein (dimer) | |
| 286 | I32-28A | Second protein (trimer) | |
| 287 | I32-28B | First protein (dimer) | |
| 288 | I53-40A.1 | First protein (pentamer) | |
| 289 | I53-40B.1 | Second protein (trimer) | |
| 290 | I53-47A.1 | Second protein (trimer) | |
| 291 | I53-47B.1 | First protein (pentamer) | |
| 292 | I53-47A.1NegT2 | Second protein (trimer) | |
| 293 | I53-47B.1NegT2 | First protein (pentamer) | |
| 294 | I53-50A.1 | Second protein (trimer) | |
| 295 | I53-50B.1 | First protein (pentamer) | |
| 296 | I53-50A.1NegT2 | Second protein (trimer) | |
| 297 | I53-50B.1NegT2 | First protein (pentamer) | |
| 298 | I53-50A.1PosT1 | Second protein (trimer) | |
| 299 | I53-50B.4PosT1 | First protein (pentamer) | |
| 300 | I53-40A genus | First protein (pentamer) | |
| 301 | I53-40B genus | Second protein (trimer) | |
| 302 | I53-47A genus | Second protein (trimer) | |
| 303 | I53-47B genus | First protein (pentamer) | |
| 304 | I53-50A genus | Second protein (trimer) | |
| 305 | I53-50B genus | First protein (pentamer) | |
| 306 | T32-28A | First protein (dimer) | |
| 307 | T32-28B | First or Second protein (trimer) | |
| 308 | T33-09A | First or Second protein (trimer) | |
| 309 | T33-09B | First or Second protein (trimer) | |
| 310 | T33-15A | First or Second protein (trimer) | |
| 311 | T33-15B | First or Second protein (trimer) | |
| 312 | T33-21A | First or Second protein (trimer) | |
| 313 | T33-21B | First or Second protein (trimer) | |
| 314 | T33-28A | First or Second protein (trimer) | |
| 315 | T33-28B | First or Second protein (trimer) | |
| 316 | T33-31A | First or Second protein (trimer) | |
| 317 | T33_dn2A | First or Second protein (trimer) | |
| 318 | T33_dn2B | First or Second protein (trimer) | |
| 319 | T33_dn5A | First or Second protein (trimer) | |
| 320 | T33_dn5B | First or Second protein (trimer) | |
| 321 | T33_dn10A | First or Second protein (trimer) | |
| 322 | T33_dn10B | First or Second protein (trimer) | |
| 323 | A/Michigan/45/2015 (H1N1) SS rpk22 676 no_lkr_dn5B.SA | Stabilized HA stem protein | Amino acid |
| 324 | A/Michigan/45/2015 (H1N1) SS rpk22 676F no_lkr_dn5B.SA | Stabilized HA stem protein | Amino acid |
| 325 | A/New Caledonia/20/1999 (H1N1) SS rpk22 676 dn5B.SA | Stabilized HA stem protein | Amino acid |
| 326 | A/USSR/90/1977 (H1N1) SS rpk22 676 no lkr dn5B.SA | Stabilized HA stem protein | Amino acid |
| 327 | A/Brevig_Mission/1/1918 (H1N1) SS rpk22 676 no lkr dn5B.SA | Stabilized HA stem protein | Amino acid |
| 328 | A/Singapore/1/1957 (H2N2) SS rpk22 676 no_lkr_dn5B.SA | Stabilized HA stem protein | Amino acid |
| 329 | A/Hong_Kong/4801/2014 (H3N2) SS no256 676 DK no lkr dn5B.SA | Stabilized HA stem protein | Amino acid |
| 330 | A/Indonesia/5/2005 (H5N1) delF SS rpk22 676 no_lkr_dn5B.SA | Stabilized HA stem protein | Amino acid |
| 331 | A/Taiwan/2/2013 (H6NI) SS rpk22 676 no lkr dn5B.SA | Stabilized HA stem protein | Amino acid |
| 332 | A/Anhui/1/2013 (H7N9) SS no256 676 no lkr dn5B.SA | Stabilized HA stem protein | Amino acid |

TABLE 1-continued

Exemplary nucleic acid and amino acid sequences

| SEQ ID NO. | Construct | Description | Sequence Type |
|---|---|---|---|
| 333 | A/Hong_Kong/33982/2009 (H9N2) SS rpk22 676 no lkr dn5B.SA | Stabilized HA st the plurality of first assemblies non-covalently interacts with the plurality of second assemblies to form the nanoparticle and the nanoparticle displays the immunogenic portion of an influenza HA protein on the exterior of the nanoparticle.

In non-limiting examples of the nanoparticles of the disclosure, each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:32, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:347, SEQ ID NO:348, and SEQ ID NO:349, wherein the plurality of identical first proteins non-covalently interact to form the first assembly. In non-limiting examples of these nanoparticles, each second protein comprises, or consists of, an amino acid sequence at least 80%, 85%, 90%, 91%, 95%, 96%, 97%, 98%, or 99% identical, or 100% identical to SEQ ID NO:89, wherein a plurality of the identical second proteins non-covalently interact to form the second assembly. In another embodiment, of the nanoparticles of the disclosure, each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:32, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, and SEQ ID NO:87, SEQ ID NO:347, SEQ ID NO:348, and SEQ ID NO:349, wherein the plurality of identical first proteins non-covalently interact to form the first assembly. In non-limiting examples of these nanoparticles, each second protein comprises, or consists of, an amino acid sequence at least 80%, 85%, 90%, 91%, 95%, 96%, 97%, 98%, or 99% identical, or 100% identical to SEQ ID NO:89, wherein a plurality of the identical second proteins non-covalently interact to form the second assembly.

In the nanoparticles of all embodiments of the disclosure, the plurality of first assemblies non-covalently interact with the plurality of second assemblies to form the nanoparticle and the nanoparticle displays the immunogenic portion of an influenza HA protein on the exterior of the nanoparticle. Production of HA-bearing nanoparticles may be performed through an in vitro assembly process from purified protein components, which can modularly accommodate different numbers and identities of HAs on the same particle.

In further non-limiting examples of these nanoparticles, each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:227, SEQ ID NO:229 SEQ ID NO:231, SEQ ID NO:233, SEQ ID NO:235, SEQ ID NO:237, SEQ ID NO:239, SEQ ID NO:241, SEQ ID NO:243, wherein the plurality of identical first proteins non-covalently interact to form the first assembly. In other non-limiting examples of these nanoparticles, each second protein comprises, or consists of, amino acid sequence at least 80%, 85%, 90%, 91%, 95%, 96%, 97%, 98%, or 99% identical, or 100% identical to a sequence selected from the group consisting of SEQ ID NO:245, SEQ ID NO:247, SEQ ID NO:249, SEQ ID NO:251, SEQ ID NO:253, SEQ ID NO:255, SEQ ID NO:257, wherein a plurality of the identical second proteins non-covalently interact to form the second assembly.

In these nanoparticles, the plurality of first assemblies non-covalently interact with the plurality of second assemblies to form the nanoparticle and the nanoparticle displays multiple copies of the immunogenic portion of an influenza HA protein on the exterior of the nanoparticle. Production of HA-bearing nanoparticles may be performed through an in vitro assembly process from purified protein components, which can modularly accommodate different numbers and identities of HAs on the same particle.

In non-limiting examples of the nanoparticles of the disclosure, the first protein and the second protein comprise, or consist of, amino acid sequences at least 80%, 85%, 90%, 91%, 95%, 96%, 97%, 98%, or 99% identical, or 100% identical, to the sequences of first and second proteins, respectively, selected from the pairs of first and second proteins in Table 2:

TABLE 2

| First Protein | | Second Protein | |
|---|---|---|---|
| Construct | SEQ ID NO | Construct | SEQ ID NO |
| I53-34B | 267 | I53-34A | 266 |
| I53-40A | 268 | I53-408 | 269 |
| I53-40A | 268 | I53-40B.1 | 289 |
| I53-40A.1 | 288 | I53-40B | 269 |
| I53-47B | 271 | I53-47A | 270 |
| I53-47B.1 | 291 | I53-47A | 270 |
| I53-47B.1NegT2 | 293 | I53-47A | 270 |
| I53-47B | 271 | I53-47A.1 | 290 |
| I53-47B.1 | 291 | I53-47A.1 | 290 |
| I53-47B.1NegT2 | 293 | I53-47A.1 | 290 |
| I53-47B | 271 | I53-47A.1NegT2 | 292 |
| I53-47B.1 | 291 | I53-47A.1NegT2 | 292 |
| I53-47B.1NegT2 | 293 | I53-47A.1NegT2 | 292 |
| I53-50B | 273 | I53-50A | 272 |
| I53-50B.1 | 295 | I53-50A | 272 |
| I53-50B.1NegT2 | 297 | I53-50A | 272 |
| I53-50B.4PosT1 | 299 | I53-50A | 272 |
| I53-50B | 273 | I53-50A.1 | 294 |
| I53-50B.1 | 295 | I53-50A.1 | 294 |
| I53-50B.1NegT2 | 297 | I53-50A.1 | 294 |
| I53-50B.4PosT1 | 299 | I53-50A.1 | 294 |
| I53-50B | 273 | I53-50A.1NegT2 | 296 |
| I53-50B.1 | 295 | I53-50A.1NegT2 | 296 |
| I53-50B.1NegT2 | 297 | I53-50A.1NegT2 | 296 |
| I53-50B.4PosT1 | 299 | I53-50A.1NegT2 | 296 |
| I53-50B | 273 | I53-50A.1PosT1 | 298 |
| I53-508.1 | 295 | I53-50A.1PosT1 | 298 |
| I53-50B.1NegT2 | 297 | I53-50A.1PosT1 | 298 |
| I53-50B.4PosT1 | 299 | I53-50A.1PosT1 | 298 |
| I53-51B | 275 | I53-51A | 274 |
| I32-06A | 282 | I32-06B | 283 |
| I32-19B | 285 | I32-19A | 284 |
| I32-28B | 287 | I32-28A | 286 |
| I53-40A.1 | 288 | I53-408.1 | 289 |
| I53-40A genus | 300 | I53-40B genus | 301 |
| I53-47B genus | 303 | I53-47A genus | 302 |
| I53-50B genus | 305 | I53-50A genus | 304 |
| T32-28A | 306 | T32-28B | 307 |
| T33-09A | 308 | T33-09B | 309 |
| T33-15A | 310 | T33-15B | 311 |
| T33-21A | 312 | T33-21B | 313 |
| T33-28A | 314 | T32-28B | 315 |
| T33-31A | 316 | T33-09B (T33-31B) | 309 |
| T33_dn2A | 317 | T33_dn2b | 318 |
| T33_dn5A | 319 | T33_dn5B | 320 |
| T33_dn10A | 321 | T33_dn10B | 322 |
| I53_dnSA | 321 | I53_dn5B | 322 |

TABLE 2-continued

| First Protein | | Second Protein | |
|---|---|---|---|
| Construct | SEQ ID NO | Construct | SEQ ID NO |
| T32-28B | 307 | T32-28A | 306 |
| T33-09B | 309 | T33-09A | 308 |
| T33-15B | 311 | T33-15A | 310 |
| T33-21B | 313 | T33-21A | 312 |
| T32-28B | 315 | T33-28A | 314 |
| T33-09B (T33-31B) | 309 | T33-31A | 316 |
| T33_dn2b | 318 | T33_dn2A | 317 |
| T33_dn5B | 320 | T33_dn5A | 319 |
| T33_dn10B | 322 | T33_dn10A | 321 |
| I53_dn5B | 89 | I53_dn5A and variants | 41, 43, 45, 47, 49, 51, 53, 55, 57, 59, 61, 63, 65, 67, 69, 71, 73, 75, 77, 79, 81, 83, 85, 87, 347, 348, 349 |

Table 3 provides the amino acid sequence of exemplary first and second proteins; the right hand column in Table 3 identifies the residue numbers in each exemplary protein that were identified as present at the interface of resulting assembled nanostructures (i.e.: "identified interface residues"). As can be seen, the number of interface residues for the exemplary first and second proteins range from 4-21. In various embodiments, the first and second proteins comprise an amino acid sequence that is at least 80%, 85%, 90%, 91%, 92%, 93%, 94%, 95%, 96%, 97%, 98%, or 99% identical to, and identical at least at 1, 2, 3, 4, 5, 6, 7, 8, 9, 10, 11, 12, 13, 14, 15, 16, 17, 18, 19, 20, or 21 identified interface positions (depending on the number of interface residues for a given protein), to the amino acid sequence of a first and/or second protein listed in Table 3. This embodiment can be combined with all other embodiments herein.

As is the case with proteins in general, the proteins are expected to tolerate some variation in the designed sequences without disrupting subsequent assembly into nanostructures: particularly when such variation comprises conservative amino acid substitutions. As used here, "conservative amino acid substitution" means that: hydrophobic amino acids (Ala, Cys, Gly, Pro, Met, See, Sme, Val, Ile, Leu) can only be substituted with other hydrophobic amino acids; hydrophobic amino acids with bulky side chains (Phe, Tyr, Trp) can only be substituted with other hydrophobic amino acids with bulky side chains; amino acids with positively charged side chains (Arg, His, Lys) can only be substituted with other amino acids with positively charged side chains; amino acids with negatively charged side chains (Asp, Glu) can only be substituted with other amino acids with negatively charged side chains; and amino acids with polar uncharged side chains (Ser, Thr, Asn, Gln) can only be substituted with other amino acids with polar uncharged side chains.

TABLE 3

| Name | Amino Acid Sequence | Identified interface residues |
|---|---|---|
| I53-34A SEQ ID NO: 266 | (M)EGMDPLAVLAESRLLPLLTVRGGEDLAGLATVLELMGVGALEITLRT EKGLEALKALRKSGLLLGAGTVRSPKEAEAALEAGAAFLVSPGLLEEVAA LAQARGVPYLPGVLTPTEVERALALGLSALKFFPAEPFQGVRVLPAYAEV FPEVRELPTGGIKEEALPHYAALPNLLAVGGSWLLQGDLAAVMKKVKAAK ALLSPQAPG | I53-34A: 28, 32, 36, 37, 186, 188, 191, 192, 195 |
| I53-34B SEQ ID NO: 267 | (M)TKKVGIVDTTFARVDMAEAAIRTLKALSPNIKIIRKTVPGIKDLPVA CKKLLEEEGCDIVMALGMPGKAEKDKVCAHEASLGLMLAQLMINKHIIEV FVHEDEAKDDDELDILALVRAIEHAANVYYLLFKPEYLTRMAGKGLRQGR EDAGPARE | I53-34B: 19, 20, 23, 24, 27, 109, 113, 116, 117, 120, 124, 148 |
| I53-40A SEQ ID NO: 268 | (M)TKKVGIVDTTFARVDMASAAILTLKMESPNIKIIRKTVPGIKDLPVA CKKLLEEEGCDIVMALGMPGKAEKDKVCAHEASLGLMLAQLMTNKHIIEV FVHEDEAKDDAELKILAARRAIEHALNVYYLLFKPEYLTRMAGKGLRQGE EDAGPARE | I53-40A: 20, 23, 24, 27, 28, 109, 112, 113, 116, 120, 124 |
| I53-40B SEQ ID NO: 269 | (M)STINNQLKALKVIPVIAIDNAEDIIPLGKVLAENGLPAAEITERSSA AVKAIMLLRSAQPEMLIGAGTILNGVQALAAKEAGATFVVSPGENPNTVR ACQIIGIDIVPGVNNPSTVEAALEMGLITLKFFPAEASGGISMVKSLVGP YGDIRLMPTGGITPSNIDNYLAIPQVLACGGTWMVDKKLVINGEWDEIAR LTREIVEQVNP | I53-40B: 47, 51, 54, 58, 74, 102 |
| I53-47A SEQ ID NO: 270 | (M)PIFTLNTNIKATDVPSDFLSLTSRLVGLILSKPGSYVAVHINTDQQL SFGGSTNPAAFGTLMSIGGIEPSKNRDHSAVLFDHLNAMLGIPKNRMYIH FVNINGDDVGWNGTTE | I53-47A: 22, 25, 29, 72, 79, 86, 87 |
| I53-47B SEQ ID NO: 271 | (M)NQHSHKDYETVRIAVVRARWHADIVDACVEAFEIAMAAIGGDRFAVD VEDVPGAYEIPLHARTLAETGRYGAVLGTAFVVNGGIYRHEFVASAVIDG MMNVQLSTGVPVLSAVLTPHRYRDSAEHHRFFAAHFAVKGVEAARACIEI LAAREKIAA | I53-47B: 28, 31, 35, 36, 39, 131, 132, 135, 139, 146 |
| I53-50A SEQ ID NO: 272 | (M)KMEELFKKHKIVAVLRANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKIGHTILKLFPGEVVGPQFVKAMKGPF PNVKFVPTGGVNLDNVCEWEKAGVLAVGVGSALVKGTPDEVREKAKAFVE KIRGCTE | I53-50A: 25, 29, 33, 54, 57 |
| I53-50B SEQ ID NO: 273 | (M)NQHSHKDYETVRIAVVRARWHAEIVDACVSAFEAAMADIGGDREAVD VFDVPGAYEIPLHARTLAETGRYGAVLGTAFVVNGGIYRHEFVASAVIDG MMNVQLSTGVPVLSAVITPHRYRDSDARTLLFLALFAVKGMEAARACVEI LAAREKIAA | I53-50B: 24, 28, 36, 124, 125, 127, 128, 129, 131, 132, 133, 135, 139 |

TABLE 3-continued

| Name | Amino Acid Sequence | Identified interface residues |
|---|---|---|
| I53-51A SEQ ID NO: 274 | (M)FTKSGDDGNTNVINKRVGKDSPLVNFLGDLDELNSFIGFAISKIPWEDMKKDLERVQVELFEIGEDLSTQSSKKKIDESYVLWLLAATAIYRIESGPVKLFVIPGGSEEASVLHVTRSVARRVERNAVKYTKELPEINRMIIVYLNRLSSLLFAMALVANKRRNQSEKIYEIGKSW | I53-51A: 80, 83, 86, 87, 88, 90, 91, 94, 166, 172, 176 |
| I53-51B SEQ ID NO: 275 | (M)NQHSHKDYETVRIAVVPARWHADIVDQCVRAFEEAMADAGGDRFAVDVFDVPGAYEIPLHARTLAETGRYGAVLGTAFVVNGGIYRHEFVASAVIDGMMNVQLSTGVPVLSAVLTPHRYRSSREHHEFFREHEMVKGVEAAAACITILAAREKIAA | I53-51B; 31, 35, 36, 40, 122, 124, 128, 131, 135, 139, 143, 146, 147 |
| I32-06A SEQ ID NO: 282 | (M)TDYIRDGSAIKALSFAIILAEADLRHIPQDLQRLAVRVIHACGMVDVANDLAFSEGAGKAGRNALLAGAPILCDARMVAEGITRSRLPADNRVIYTLSDPSVPELAKKIGNTRSAAALDLWLPHIEGSIVAIGNAPTALFRLFELLDAGAPKPALIIGMPVGFVGAAESKDELAANSRGVPYVIVRGRRGGSAMTAAAVNALASERE | I32-06A: 9, 12, 13, 14, 20, 30, 33, 34 |
| I32-06B SEQ ID NO: 283 | (M)ITVFGLKSKLAPRREKLAEVIYSSLHLGLDIPKGKHAIRFLCLEKEDFYYPEDRSDDYTVIEINIMAGRSEETKMLLIFLLFIALERKLGIRAHDVEITIKEQPAHCWGFRGRTGDSARDLDYDIYV | I32-06B: 24, 71, 73, 76, 77, 80, 81, 84, 85, 88, 114, 118 |
| I32-19A SEQ ID NO: 284 | (M)GSDLQKLQRFSTCDISDGLLNVYNIPTGGYFPNLTAISPPQNSSIVGTAYTVLFAPIDDPRPAVNYIDSVPPNSILVLALEPHLQSFHPFIKITQAMYGGLMSTRAQYLKSNGTVVFGRIRDVDEHRTLNHPVFAYGVGSCAPKAVVKAVGINVQLKILTSDGVTQTICPGDYIAGDNNGIVRIPVQETDISKLVTYIEKSIEVDRLVSEAIKNGLPAKAAQTARRMVLKDYI | I32-19A: 208, 213, 218, 222, 225, 226, 229, 233 |
| I32-19B SEQ ID NO: 285 | (M)SGMRVYLGADHAGYELKQAIIAFLKMTGHEPIDCGALRYDADDDYPAFCIAAATRTVADPGSLGIVLGGSGNGEQIAANKVPGARCALAWSVQTAALAREHNNAQLIGIGGRMHTLEEALRIVKAFVTTPWSKAQRHQRRIDILAEYERTHEAPPVPGAPA | I32-19B; 20, 23, 24, 27, 117, 118, 122, 125 |
| I32-28A SEQ ID NO: 286 | (M)GDDARIAAIGDVDELNSQIGVLLAEPLPDDVRAALSAIQHDLEDLGGELCIPGHAAITEDHLLRLALWLVHYNGQLPPLEEFILPGGARGAALAHVCRTVCRRAERSIKALGASEPLNIAPAAYVNLLSDLLFVLARVLNRAAGGADVEWDRTRAH | I32-28A: 60, 61, 64, 67, 68, 71, 110, 120, 123, 124, 128 |
| I32-28B SEQ ID NO: 287 | (M)ILSAEQSFTLRHPHGQAAALAFVREPAAALAGVQRLRGLDSDGEQVWGELLVRVPLLGEVDLPERSEIVRTPQGAELRPLTLTGERAWVAVSGQATAAEGGEMAFAFQFQAHLATPEAEGEGGAAFEVMVQAAAGVTLLLVAMALPQGLAAGLPPA | I32-28B; 35, 36, 54, 122, 129, 137, 140, 141, 144, 148 |
| I53-40A.1 SEQ ID NO: 288 | (M)TKKVGIVDTTFARVDMASAAILTLKMESPNIKIIRKTVPGIKDLPVACKKLLEEEGCDIVMALGMPGKKEKDKVCAHEASLGLMLAQLMTNKHIIEVFVHEDEAKDDAELKILAARRAIERALNVYYLLFKPEYLTRMAGKGLRQGEEDAGPARE | I53-40A: 20, 23, 24, 27, 28, 109, 112, 113, 116, 120, 124 |
| I53-40B.1 SEQ ID NO: 289 | (M)DDINNQLKRIKVIPVIAIDNAEDIIPLGKVLAENGLPAAEITERSSAAVKAIMLLRSAQPEMLIGAGTILNGVQALAAKEAGADFVVSPGENPNTVRACQIIGIDIVPGVNNPSTVEQALEMGLTTLKFFPAEASGGISMVKSLVGPYGDIRLMPTGGITPDNIDNYLAIPQVLACGGTWMVDKKLVRNGEWDEIARLTREIVEQVNP | I53-40B: 47, 51, 54, 58, 74, 102 |
| I53-47A.1 SEQ ID NO: 290 | (M)PIFTINTNIKADDVPSDFLSLTSRLVGLILSKPGSYVAVHINTDQQLSFGGSTNPAAFGTLMSIGGIEPDKNRDASAVLFDHLNAMLGIPKNRMYIHFVNINGDDVGWNGTTF | I53-47A: 22, 25, 29, 72, 79, 86, 87 |
| I53-47A.1NegT2 SEQ ID NO: 292 | (M)PIFTINTNIKADDVPSDFLSLTSRLVGLILSEPGSYVAVHINTDQQLSFGGSTNPAAFGTLMSIGGIEPDKNEDHSAVLFDHLNAMLGIPKNRMYIHFVDLDGDDVGWNGTTF | I53-47A: 22, 25, 29, 72, 79, 86, 87 |
| I53-47B.1 SEQ ID NO: 291 | (M)NQHSHKDHETVRIAVVRARWHADIVDACVEAFEIAMAAIGGDREAVDVFDVPGAYEIPLHARTLAETGRYGAVLGTAFVVNGGIYRHEFVASAVIDGMMNVQLDTGVPVLSAVLTPHRYRDSDEHHRFFAAHFAVKGVEAARACIEILNARERIAA | I53-47B: 28, 31, 35, 36, 39, 131, 132, 135, 139, 146 |
| I53-47B.1NegT2 SEQ ID NO: 293 | (M)NQHSHKDHETVRIAVVRARWHADIVDACVEAFEIAMAAIGGDREAVDVEDVPGAYEIPLHARTLAETGRYGAVLGTAFVVDGGIYDHEFVASAVIDGMMNVQLDTGVPVLSAVLTPHEYEDSDEDHEFFAARFAVKGVEAARACIEILNAREKIAA | I53-47B: 28, 31, 35, 36, 39, 131, 132, 135, 139, 146 |
| I53-50A.1 SEQ ID NO: 294 | (M)KMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPEPNVKFVPTGGVNLDNVCEWEKAGVLAVGVGDALVKGDPDEVREKAKKFVEKIRGCTE | I53-50A: 25, 29, 33, 54, 57 |

TABLE 3-continued

| Name | Amino Acid Sequence | Identified interface residues |
|---|---|---|
| I53-50A.1NegT2 SEQ ID NO: 296 | (M)KMEELFKKHKIVAVERANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKLGHDILKLFPGEVVGPEFVEAMKGPF PNVKFVPTGGVDLDDVCEWFDAGVLAVGVGDALVEGDPDEVREDAKEFVE EIRGCTE | I53-50A: 25, 29, 33, 54, 57 |
| I53-50A.1PosT1 SEQ ID NO: 298 | (M)KMEELFKKHKIVAVLRANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKLGHDILKLFPGEVVGPQFVKAMKGPE PNVKFVPTGGVNLDNVCKWFKAGVLAVGVGKALVKGKPDEVREKAKKFVK KIRGCTE | I53-50A: 25, 29, 33, 54, 57 |
| I53-50B.1 SEQ ID NO: 295 | (M)NQHSHKDHETVRIAVVRARWHAEIVDACVSAFEAAMRDIGGDREAVD VEDVPGAYEIPLHARTLAETGRYGAVLGTAFVVNGGIYRHEFVASAVIDG MMNVQLDTGVPVLSAVLTPHRYRDSDAHTLLFLALFAVKGMEAARACVEI LAAREKIAA | I53-50B: 24, 28, 36, 124, 125, 127, 128, 129, 131, 132, 133, 135, 139 |
| I53-50B.1NegT2 SEQ ID NO: 297 | (M)NQHSHKDHETVRIAVVRARWHAEIVDACVSAFEAAMRDIGGDREAVD VFDVPGAYEIPLHARTLAETGRYGAVLGTAFVVDGGIYDHEFVASAVIDG MMNVQLDTGVPVLSAVLTPHEYEDSDADTLLFLALFAVKGMEAARACVEI LAAREKIAA | I53-50B: 24, 28, 36, 124, 125, 127, 128, 129, 131, 132, 133, 135, 139 |
| I53-50B.4PosT1 SEQ ID NO: 299 | (M)NQHSHKDHETVRIAVVRARWHAEIVDACVSAFEAAMRDIGGDREAVD VFDVPGAYEIPLHARTLAETGRYGAVLGTAFVVNGGIYRHEFVASAVING MMNVQLNTGVPVLSAVLTPHNYDKSKAHTLLFLALFAVKGMEAARACVEI LAAREKIAA | I53-50B: 24, 28, 36, 124, 125, 127, 128, 129, 131, 132, 133, 135, 139 |
| I53_dn5A (SEQ ID NO: 41) | MGKYDGSKERIGILHARWNAEIILALVLGALKRLQEFGVKRENIIIETVP GSFELPYGSKLFVEKQKRLGKPLDAIIPIGVLIKGSTMHFEYICDSTTHQ LMKLNFELGIPVIFGVLTCLTDEQAEARAGLIEGKMHNHGEDWGAAAVEM ATKEN | I53_dn5A: 3, 15, 17, 20, 21, 23, 24, 27, 28, 31, 41, 46, 48 |
| I53-dn5B (SEQ ID NO: 89) | EEAELAYLLGELAYKLGEYRIAIRAYRIALKRDPNNAEAWYNLGNAYYKQ GRYREAIEYYQKALELDPNNAEAWYNLGNAYYERGEYEEAIEYYRKALRL DPNNADAMQNLLNAKMREE | 153_dn5B 52, 54, 83, 84, 85, 86, 95, 98, 99, 102, 105, 106, 108, 109, 111, 112, 115, 116, 117, 118, 119 |
| I53-dn5 A.1 (A_LF4_W16G) SEQ ID NO: 43 | MGKYDGSKLRIGILHARGNAEIILALVLGALKRLQEFGVKRENIIIETVP GSFELPYGSKLFVEKQKRLGKPLDAIIPIGVLIRGSTPHFDYIADSTTHQ LMKINFELGIPVIFGVITADTDEQAEARAGLIEGKMHNHGEDWGAAAVEM ATREN | I53_dn5A: 3, 15, 17, 20, 21, 23, 24, 27, 28, 31, 41, 46, 48 |
| I53-dn5 A.2 (A_LF2_W16G_LS) SEQ ID NO: 45 | MGKYDGSKLRIGILHARGNAEIILELVLGALKRLQEFGVKRENIIIETVP GSFELPYGSKLFVEKQKRLGKPLDAIIPIGVLIRGSTAHFDYIADSTTHQ LMKINFELGIPVIFGVLTTESDEQAEERAGTKAGNHGEDWGAAAVEMATK FN | I53_dn5A 3, 15, 17, 20, 21, 23, 24, 27, 28, 31, 41, 46, 48 |
| I53-dn5 A_LF2_W16G_RS SEQ ID NO: 47 | MGKYDGSKLRIGILHARGNAEIILALVLGALKRLQEFGVKRENIIIETVP GSFELPYGSKLFVEKQKRKGEPLDAIIPIGVLIRGSTAHFDYIADSTTHQ LMKINFELGIPVIFGVLTTESDEQAEERAGLIEGKMHNHGEDWGAAAVEM ATKFN | I53_dn5A: 3, 15, 17, 20, 21, 23, 24, 27, 28, 31, 41, 46, 48 |
| I53-dn5 A_LF4_W16E_LS_RS SEQ ID NO: 49 | MGKYDGSKLRIGILHARENAEIILELVLGALKRLQEFGVKRENIIIETVP GSFELPYGSKLFVEKQKRKGEPLDAIIPIGVLIRGSTPHFDYIADSTTHQ LMKLNFELGIPVIFGVITADTDEQAEERAGTKAGNHGEDWGAAAVEMATK FN | I53_dn5A: 3, 15, 17, 20, 21, 23, 24, 27, 28, 31, 41, 46, 48 |
| I53-dn5 A_LF2_W16G SEQ ID NO: 51 | MGKYDGSKLRIGILHARGNAEIILALVLGALKRLQEFGVKRENIIIETVP GSFELPYGSKLFVEKQKRIGKPLDAIIPIGVLIRGSTAHFDYIADSTTHQ IMKINFELGIPVIFGVLTTESDEQAEARAGLIEGKMHNHGEDWGAAAVEM ATKN | I53_dn5A; 3, 15, 17, 20, 21, 23, 24, 27, 28, 31, 41, 46, 48 |
| I53-dn5 A_LF2_W16E_LS SEQ ID NO: 53 | MGKYDGSKLRIGILHARENAEIILELVLGALKRLQEFGVKRENIIIETVP GSFELPYGSKLFVEKQKRLGKPLDAIIPIGVLIRGSTAHFDYIADSTTHQ LMKLNFELGIPVIFGVLTTESDEQAEERAGTKAGNHGEDWGAAAVEMATK FN | I53_dn5A: 3, 15, 17, 20, 21, 23, 24, 27, 28, 31, 41, 46, 48 |
| I53-dn5 A_LF4_W16E SEQ ID NO: 55 | MGKYDGSKLRIGILHARENAEIILALVLGALKRLQEFGVKRENIIIETVP GSFELPYGSKLFVEKQKRIGKPLDAIIPIGVLIRGSTPHFDYIADSTTHQ LMKLNFELGIPVIFGVITADTDEQAEARAGLIEGKMHNHGEDWGAAAVEM ATKEN | I53_dn5A: 3, 15, 17, 20, 21, 23, 24, 27, 28, 31, 41, 46, 48 |

TABLE 3-continued

| Name | Amino Acid Sequence | Identified interface residues |
| --- | --- | --- |
| I53-dn5 A_LF4_ W16E_LS SEQ ID NO: 57 | MGKYDGSKERIGILHARENAEIILELVLGALKRLQEFGVKRENIIIETVP GSFELPYGSKLFVEKQKRIGKPLDAIIPIGVLIRGSTPHFDYIADSTTHQ LMKINFELGIPVIFGVITADTDEQAEERAGTKAGNHGEDWGAAAVEMATK FN | I53_dn5A: 3, 15, 17, 20, 21, 23, 24, 27, 28, 31, 41, 46, 48 |
| I53-dn5 A_LF2_ W16E_LS_RS SEQ ID NO: 59 | MGKYDGSKLRIGILHARENAEIILELVLGALKRLQEFGVKRENIIIETVP GSFELPYGSKLFVEKQKRKGEPLDAIIPIGVLIRGSTAHFDYIADSTTHQ LMKINFELGIPVIFGVLTTESDEQAEERAGTKAGNHGEDWGAAAVEMATK FN | I53_dn5A. 3, 15, 17, 20, 21, 23, 24, 27, 28, 31, 41, 46, 48 |
| I53-dn5 A_LF4_ W16G_RS SEQ ID NO: 61 | MGKYDGSKERIGILHARGNAEIILALVLGALKRLQEFGVKRENIIIETVP GSFELPYGSKLFVEKQKRKGEPLDAIIPIGVLIRGSTPHFDYIADSTTHQ LMKLNFELGIPVIFGVITADTDEQAEAPAGLIEGKMANAGEDWGAAAVEM ATKEN | I53_dn5A: 3, 15, 17, 20, 21, 23, 24, 27, 28, 31, 41, 46, 48 |
| I53-dn5 A_LF2_ W16E SEQ ID NO: 63 | MGKYDGSKLRIGILHARENAEIILALVLGALKRLQEFGVKRENIIIETVP GSFELPYGSKIFVEKQKREGKPLDAIIPIGVLIRGSTAHFDYIADSTTHQ LMKINFELGIPVIFGVLTTESDEQAEARAGLIEGKMHNHGEDWGAAAVEM ATKFN | I53_dn5A: 3, 15, 17, 20, 21, 23, 24, 27, 28, 31, 41, 46, 48 |
| I53-dn5 A_LF4_ W16G_LS SEQ ID NO: 65 | MGKYDGSKLRIGILHARGNAEIILELVLGALKRLQEFGVKRENIIIETVP GSFELPYGSKIFVEKQKRLGKPLDAIIPIGVLIRGSTPHFDYIADSTTHQ IMKINFELGIPVIFGVITADTDEQAEERAGTKAGNHGEDWGAAAVEMATK FN | I53_dn5A: 3, 15, 17, 20, 21, 23, 24, 27, 28, 31, 41, 46, 48 |
| I53-dn5 mIgK.A.2 (A_LF2_ W16G_LS) SEQ ID NO: 67 | METDTLLLWVLLLWVPGSTGDYKDEMGKYDGSKLRIGILHARGNAEIILE LVLGALKRLQEFGVKRENIIIETVPGSFELPYGSKLFVEKQKRLGKPLDA IIPIGVLIRGSTAHFDYIADSTTHQLMKENFELGIPVIFGVLTTESDEQA EERAGTKAGNHGEDWGAAAVEMATKEN | 153_du5A: 28, 40, 42, 45, 46, 48, 49, 52, 53, 56, 66, 71, 73 |
| I53-dn5 mIgK.A_ LF4_W16G_ LS SEQ ID NO: 69 | METDTLLLWVLLLWVPGSTGDYKDEMGKYDGSKLRIGILHARGNAEIILE LVLGALKRLQEFGVKRENIIIETVPGSFELPYGSKLFVEKQKRLGKPLDA IIPIGVLIRGSTPHFDYIADSTTHQLMKINFELGIPVIFGVITADTDEQA EERAGTKAGNHGEDWGAAAVEMATKEN | I53_dn5A: 28, 40, 42, 45, 46, 48, 49, 52, 53, 56, 66, 71, 73 |
| I53-dn5 mIgK.A_ LF4_W16E_ LS SEQ ID NO: 71 | METDTLLLWVLLLWVPGSTGDYKDEMGKYDGSKLRIGILHARENAEIILE LVLGALKRLQEFGVKRENIIIETVPGSFELPYGSKLFVEKQKRLGKPLDA IIPIGVLIRGSTPHFDYIADSTTHQLMKLNFELGIPVIFGVITADTDEQA EERAGTKAGNHGEDWGAAAVEMATKEN | I53_dn5A: 28, 40, 42, 45, 46, 48, 49, 52, 53, 56, 66, 71, 73 |
| I53-dn5 mIgK.A_ LF2_W16E_ LS SEQ ID NO: 73 | METDTLLLWVLLLWVPGSTGDYKDEMGKYDGSKLRIGILHARENAEIILE LVLGALKRLQEFGVKRENIIIETVPGSFELPYGSKLFVEKQKRLGKPLDA IIPIGVLIRGSTAHFDYIADSTTHQLMKLNFELGIPVIFGVLTTESDEQA EERAGTKAGNHGEDWGAAAVEMATKEN | I53_dn5A: 28, 40, 42, 45, 46, 48, 49, 52, 53, 56, 66, 71, 73 |
| I53-dn5 mIgK.A_ LF2_W16E SEQ ID NO: 75 | METDTLLLWVLLLWVPGSTGDYKDEMGKYDGSKLRIGILHARENAEIILA LVLGALKRLQEFGVKRENIIIETVPGSFELPYGSKLFVEKQKRLGKPLDA IIPIGVLIRGSTAHFDYIADSTTHQLMKINFELGIPVIFGVLTTESDEQA EARAGLIEGKMHNHGEDWGAAAVEMATKEN | I53_dn5A: 28, 40, 42, 45, 46, 48, 49, 52, 53, 56, 66, 71, 73 |
| I53-dn5 m_gK.A_ W16E SEQ ID NO: 77 | METDTLLLWVLLLWVPGSTGDYKDEMGKYDGSKLRIGILHARENAEIILA LVLGALKRLQEFGVKRENIIIETVPGSFELPYGSKLFVEKQKRLGKPLDA IIPIGVLIRGSTAHFDYIADSTTHQLMKENFELGIPVIFGVLTTESDEQA EARAGLIEGKMHNHGEDWGAAAVEMATKEN | I53_dn5A: 28, 40, 42, 45, 46, 48, 49, 52, 53, 56, 66, 71, 73 |
| I53-dn5 migK.A_ LF2_W16E_ LS_RS SEQ ID NO: 79 | METDTLLLWVLLLWVPGSTGDYKDEMGKYDGSKLRIGILHARENAEIILE LVLGALKRLQEFGVKRENIIIETVPGSFELPYGSKLEVEKQKRKGEPLDA IIPIGVLIRGSTAHFDYIADSTTHQUMKINFELGIPVIFGVLTTESDEQA EERAGTKAGNHGEDWGAAAVEMATKEN | I53_dn5A; 28, 40, 42, 45, 46, 48, 49, 52, 53, 56, 66, 71, 73 |
| I53-dn5 mlgK.A_ LF4_W16E_ LS_RS SEQ ID NO: 81 | METDTLLLWVLLLWVPGSTGDYKDEMGKYDGSKLRIGILHARENAEIILE LVLGALKRLQEFGVKRENIIIETVPGSFELPYGSKLFVEKQKRKGEPLDA IIPIGVLIRGSTPHFDYIADSTTHQLMKINFELGIPVIFGVITADTDEQA EERAGTKAGNHGEDWGAAAVEMATKEN | I53_dn5A: 28, 40, 42, 45, 46, 48, 49, 52, 53, 56, 66, 71, 73 |

TABLE 3-continued

| Name | Amino Acid Sequence | Identified interface residues |
|---|---|---|
| I53-dn5 mIgK.A_ LF4_W16G_ RS SEQ ID NO: 83 | METDTLLLWVLLLWVPGSTGDYKDEMGKYDGSKLRIGILHARGNAEIILA LVLGALKRLQEFGVKRENIIIETVPGSFELPYGSKLFVEKQKRKGEPLDA IIPIGVLIRGSTPHFDYIADSTTHQLMKINFELGIPVIFGVITADTDEQA EARAGLIEGKMHNHGEDWGAAAVEMATKEN | I53_dn5A: 28, 40, 42, 45, 46, 48, 49, 52, 53, 56, 66, 71, 73 |
| I53-dn5 migK.A_ LF4_W16E SEQ ID NO: 85 | METDTLLLWVLLLWVPGSTGDYKDEMGKYDGSKLRIGILHARENAEIILA LVLGALKRLQEFGVKRENIIIETVPGSFELPYGSKLFVEKQKRLGKPLDA IIPIGVLIRGSTPHFDYIADSTTHQLMKINFELGIPVIFGVITADTDEQA EARAGLIEGKMANAGEDWGAAAVEMATKEN | I53_dn5A: 28, 40, 42, 45, 46, 48, 49, 52, 53, 56, 66, 71, 73 |
| I53-dn5 mIgK.A_ LF2_W16G RS SEQ ID NO: 87 | METDTLLLWVLLLWVPGSTGDYKDEMGKYDGSKLRIGILHARGNAEIILA LVLGALKRLQEFGVKRENIIIETVPGSFELPYGSKLFVEKQKRKGEPLDA IIPIGVLIRGSTAHFDYIADSTTHQLMKINFELGIPVIFGVLTTESDEQA EARAGLIEGKMHNHGEDWGAAAVEMATKEN | I53_dn5A: 28, 40, 42, 45, 46, 48, 49, 52, 53, 56, 66, 71, 73 |
| I53-dn5 mIgK-mod.A.2 (A_LF2_W16G_LS) SEQ ID NO: 347 | METDTLLLWVLLLWVPGSTGDKYDGSKLRIGILHARGNAEIILELVLGAL KRLQEFGVKRENIIIETVPGSFELPYGSKLFVEKQKRLGKPLDAIIPIGV LIRGSTAHFDYIADSTTHQLMKINFELGIPVIFGVETTESDEQAEERAGT KAGNHGEDWGAAAVEMATKEN | I53_dn5A: 22, 34, 36, 39, 40, 42, 43, 46, 47, 50, 60, 65, 67 |
| I53-dn5 Prolactin.A LF4_W16E SEQ ID NO: 348 | MDSKGSSQKGSRLLLLLVVSNLLLPQGVLAKYDGSKLRIGILHARENAEI ILALVLGALKRLQEFGVKRENIIIETVPGSFELPYGSKLEVEKQKRLGKP LDAIIPIGVLIRGSTPHFDYIADSTTHQLMKINFELGIPVIFGVITADTD EQAEARAGLIEGKMHNHGEDWGAAAVEMATKEN | I53_dn5A: 31, 43, 45, 48, 49, 51, 52, 55, 56, 59, 69, 74, 76 |
| I53-dn5 Prolactin.A (A_LF2_W16G_LS) SEQ ID NO: 349 | MDSKGSSQKGSRLLLLLVVSNLLLPQGVLAKYDGSKLRIGILHARGNAEI ILELVLGALKRLQEFGVKRENIIIETVPGSFELPYGSKLEVEKQKRLGKP LDAIIPIGVLIRGSTAHFDYIADSTTHQLMKINFELGIPVIFGVLTTESD EQAEERAGTKAGNHGEDWGAAAVEMATKEN | I53_dn5A: 31, 43, 45, 48, 49, 51, 52, 55, 56, 59, 69, 74, 76 |

Table 4 lists surface amino acid residue numbers for exemplary first and second proteins of the disclosure. Thus, in various embodiments, 1 or more (at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more) of these surface residues may be modified in the first and/or second proteins listed in Table 4. This embodiment can be combined with all other embodiments herein. Residues in parentheses are optional.

TABLE 4

| Name | Amino Acid Sequence | Surface residues not near interface |
|---|---|---|
| I53-34A SEQ ID NO: 266 | (M)EGMDPLAVLAESRLLPLLTVRGGEDLAGLATVLELMGVGALEITLRT EKGLEALKALRKSGLLLGAGTVRSPKEAEAALEAGAAFLVSPGLLEEVAA LAQARGVPYLPGVLTPTEVERALALGLSALKFFPAEPFQGVRVLRAYAEV FPEVRFLPTGGIKEEHLPHYAALPNLLAVGGSWLLQGDLAAVMKKVKAAK ALLSPQAPG | I53-34A: 6, 8, 9, 12, 14, 22, 25, 48, 49, 50, 52, 53, 56, 73, 74, 81, 94, 95, 101, 102, 103, 104, 119, 122, 137, 140, 143, 147, 150, 151, 153, 161, 162, 163, 164, 166, 167, 170, 172, 184, 193, 198, 199, 200, 202 |
| I53-34B SEQ ID NO: 267 | (M)TKKVGIVDTTFARVDMAEAAIRTLKALSPNIKIIRKTVPGIKDLPVA CKKLLEEEGCDIVMALGMPGKAEKDKVCAHEASLGIMLAQLMTNKHIIEV FVHEDEAKDDDELDILALVRAIERAANVYYLLFKPEYLTRMAGKGLRQGR EDAGPARE | I53-34B: 3, 12, 31, 33, 35, 36, 51, 54, 55, 56, 59, 69, 70, 71, 74, 93, 103, 106, 107, 108, 131, 132, 133, 134, 138, 142, 153 |
| I53-40A SEQ ID NO: 268 | (M)TKKVGIVDTTFARVDMASAAILTLKMESPNIKIIRKTVPGIKDLPVA CKKLLEEEGCDIVMALGMPGKAEKDKVCAHEASLGLMLAQLMTNKHIIEV FVHEDEAKDDAELKILAARRAIEHALNVYYLLFKPEYLTRMAGKGLRQGE EDAGPARE | I53-40A: 3, 4, 31, 33, 35, 36, 37, 51, 54, 55, 56, 57, 59, 69, 70, 71, 74, 93, 103, 106, 118, 127, 128, 131, 132, 133, 134, 135, 138, 139, 142, 150, 153 |
| I53-40B SEQ ID | (M)STINNQLKALKVIPVIAIDNAEDIIPLGKVLAENGLPAAEITERSSA AVKAIMLLRSAQPEMLIGAGTILNGVQALAAKEAGATFVVSPGENPNTVR | I53-40B: 2, 3, 7, 9, 10, 12, 20, 21, |

TABLE 4-continued

| Name | Amino Acid Sequence | Surface residues not near interface |
|---|---|---|
| NO: 269 | ACQIIGIDIVPGVNNPSTVEAALEMGLTTLKFFPAEASGGISMVKSLVGP YGDIRLMPTGGITPSNIDNYLAIPQVLACGGTWMVDKKLVINGEWDEIAR LTREIVEQVNP | 23, 26, 27, 30, 34, 38, 45, 60, 62, 75, 85, 94, 95, 122, 124, 126, 134, 139, 143, 151, 153, 161, 163, 166, 167, 170, 172, 180, 184, 185, 186, 189, 190, 192, 193, 194, 195, 198, 201, 202, 205, 208, 209 |
| I53-47A SEQ ID NO: 270 | (M)PIFTLNTNIKATDVPSDFLSLTSRLVGLILSKPGSYVAVHINTDQQL SFGGSTNPAAFGTLMSIGGIEPSKNRDHSAVLEDHINAMLGIPKNRMYTH FVNINGDDVGWNGTTE | I53-47A: 11, 13, 14, 17, 34, 36, 37, 45, 47, 54, 55, 56, 65, 69, 70, 71, 74, 91, 92, 93, 101, 103, 105, 109, 110, 112, 114 |
| I53-47B SEQ ID NO: 271 | (M)NQHSHKDYETVRIAVVRARWHADIVDACVEAFEIAMAAIGGDRFAVD VFDVPGAYEIPLHARTLAETGRYGAVLGTAFVVNGGIYRHEFVASAVIDG MMNVQLSTGVPVLSAVLTPHRYRDSAEHHRFFAAHFAVKGVEAARACIEI LAAREKIAA | I53-47B; 6, 7, 8, 9, 10, 11, 13, 18, 20, 21, 24, 43, 44, 51, 63, 67, 70, 85, 87, 101, 105, 122, 123, 124, 125, 126, 147, 152, 153, 154 |
| I53-50A SEQ ID NO: 272 | (M)KMEELFKKHKIVAVLRANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKIGHTILKLFPGEVVGPQFVKAMKGPF PNVKFVPTGGVNLDNVCEWFKAGVLAVGVGSALVKGTPDEVREKAKAFVE KIRGCTE | I53-50A: 4, 5, 6, 8, 9, 11, 17, 19, 23, 37, 46, 47, 59, 74, 77, 78, 81, 94, 95, 98, 101, 102, 103, 106, 119, 122, 126, 139, 142, 145, 149, 150, 152, 160, 161, 162, 163, 166, 169, 179, 183, 185, 188, 191, 192, 194, 198, 199 |
| I53-50B SEQ ID NO: 273 | (M)NQHSHKDYETVRIAVVPARWHAEIVDACVSAFEAAMADIGGDREAVD VFDVPGAYEIPLHARTLAETGRYGAVLGTAFVVNGGIYRHEFVASAVIDG MMNVQLSTGVPVLSAVLTPHRYRDSDAHTLLFLALFAVKGMEAARACVEI LAAREKIAA | I53-50B: 6, 7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53-51A SEQ ID NO: 274 | (M)FTKSGDDGNINVINKRVGKDSPLVNFLGDLDELNSFIGFAISKIPWE DMKKDLERVQVELFEIGEDLSTQSSKKKIDESYVIWLLAATAIYRIESGP VKLFVIPGGSEEASVLHVTRSVARRVERNAVKYTKELPEINRMIIVYLNR LSSLLFAMALVANKRRNQSEKIYEIGKSW | I53-51A: 19, 20, 24, 28, 46, 47, 51, 70, 71, 73, 74, 75, 76, 102, 122, 130, 133, 134, 135, 136, 137, 140, 162, 163, 164, 165, 169, 175, 177 |
| I53-51B SEQ ID NO: 275 | (M)NQHSHKDYETVRIAVVRARWHADIVDQCVRAFEEAMADAGGDRFAVD VFDVPGAYEIPLHARTLAETGRYGAVLGTAFVVNGGIYRHEFVASAVIDG MMNVQLSTGVPVLSAVLTPHRYRSSREHHEFFREHFMVKGVEAAAACITI LAAREKIAA | I53-51B: 6, 7, 8, 9, 10, 11, 13, 18, 21, 27, 34, 38, 43, 48, 63, 67, 70, 85, 87, 101, 118, 125, 126, 129, 152, 153, 154 |
| I32-06A SEQ ID NO: 282 | (M)TDYIRDGSAIKALSFAIILAEADLRHIPQDLQRLAVRVIHACGMVDV ANDLAFSEGAGKAGRNALLAGAPILCDARMVAEGITRSRLPADNRVIYTL SDPSVPELAKKIGNTRSAAALDLWLPHIEGSIVAIGNAPTALFRLFELLD AGAPKPALIIGMPVGFVGAAESKDELAANSRGVPYVIVRGRRGGSAMTAA AVNALASERE | I32-06A: 24, 26, 27, 41, 47, 50, 51, 56, 60, 63, 64, 67, 68, 77, 84, 85, 86, 91, 93, 98, 99, 100, 101, 102, 105, 108, 109, 114, 123, 124, 125, 127, 135, 142, 145, 148, 149, 152, 153, 169, 172, 173, 176, 177, 180, 187, 189 |
| I32-06B SEQ ID NO: 283 | (M)ITVFGLKSKLAPRREKLAEVIYSSLHLGLDIPKGKHAIRFLCLEKED FYYPFDRSDDYTVIEINIMAGRSEETKMLLIFLLFIALERKLGIRAHDVE ITIKEQPAHCWGERGRTGDSARDLDYDIYV | I32-06B: 8, 9, 10, 13, 14, 15, 16, 17, 20, 34, 36, 45, 46, 47, 50, 51, 53, 54, 57, 67, 70, 91, 93, 95, 105, 112 |
| I32-19A SEQ ID NO: 284 | (M)GSDLQKLQRFSTCDISDGLLNVYNIPTGGYFPNLTAISPPQNSSIVG TAYTVLFAPIDDPRPAVNYIDSVPPNSILVLALEPHLQSQFHPFIKITQA MYGGLMSTRAQYLKSNGTVVFGRIRDVDEHRTENHPVFAYGVGSCAPKQV VKAVGTNVQLKILTSDGVTQTICPGDYIAGDNNGIVRIPVQETDISKLVT YIEKSIEVDRLVSEAIKNGLPAKAAQTARPMVLKDYI | I32-19A: 3, 4, 6, 7, 9, 10, 25, 27, 36, 40, 42, 43, 44, 49, 58, 59, 61, 62, 63, 70, 72, 73, 74, 82, 84, 88, 89, 109, 110, 112, 126, 127, 129, 130, 132, 146, 155, 156, 157, 159, 166, 169, 172, 189, 190, 192, 194, 195, 198, 201, 204, 215, 232 |
| I32-19B SEQ ID NO: 285 | (M)SGMRVYLGADHAGYELKQAIIAFLKMTGHEPIDCGALRYDADDDYPA FCIAAATRTVADPGSLGIVLGGSGNGEQIAANKVPGARCALAWSVQTAAL AREHNNAQLIGIGGRMHTLEEALRIVKAFVTTPWSKAQRHQRRIDILAEY | I32-19B: 4, 5, 31, 33, 38, 41, 42, 43, 55, 56, 59, 61, 62, 83, 93, 94, 101, |

TABLE 4-continued

| Name | Amino Acid Sequence | Surface residues not near interface |
|---|---|---|
| | ERTHEAPPVPGAPA | 104, 113, 119, 129, 131, 134, 136, 137, 139, 140, 143, 144, 146, 147, 150, 152, 153, 156, 158, 159 |
| I32-28A SEQ ID NO: 286 | (M)GDDARIAAIGDVDELNSQIGVLLAEPLPDDVRAALSAIQHDLEDLGG ELCIPGHAAITEDALLRLALWLVHYNGQLPPLEEFILPGGARGAALARVC RTVCRRAERSIKALGASEPLNIAPAAYVNLLSDLLFVLARVLNRAAGGAD VLWDRTRAH | I32-28A: 4, 6, 7, 10, 14, 27, 30, 31, 33, 34, 41, 44, 45, 51, 52, 53, 54, 55, 56, 59, 76, 78, 79, 80, 81, 82, 83, 90, 103, 111, 115, 116, 131, 134, 142, 145, 147, 150 |
| I32-28B SEQ ID NO: 287 | (M)ILSAEQSFTLRHPHGQAAALAFVREPAAALAGVQRLRGLDSDGEQVW GELLVRVPLLGEVDLPERSEIVRTPQGAELRPLTLTGERAWVAVSGQATA AEGGEMAFAFQFQAHLATPEAEGEGGAAFEVMVQAAAGVTLLLVAMALPQ GLAAGLPPA | I32-28B: 3, 4, 6, 8, 12, 15, 17, 18, 22, 26, 28, 32, 38, 39, 41, 43, 45, 46, 48, 50, 60, 66, 68, 71, 73, 74, 79, 81, 82, 83, 84, 86, 87, 95, 100, 103, 105, 109, 111, 113, 151, 152, 155, 156, 157 |
| I53-40A.1 SEQ ID NO: 288 | (M)TKKVGIVDTTFARVDMASAAILTLKMESPNIKIIRKTVPGIKDLPVA CKKLLEEEGCDIVMALGMPGKKEKDKVCAHEASLGEMLAQLMINKHIIEV FVHEDEAKDDAELKILAARRAIEHALNVYYLLFKPEYLTRMAGKGLRQGE EDAGPARE | I53-40A: 3, 4, 31, 33, 35, 36, 37, 51, 54, 55, 56, 57, 59, 69, 70, 71, 74, 93, 103, 106, 118, 127, 128, 131, 132, 133, 134, 135, 138, 139, 142, 150, 153 |
| I53-40B.1 SEQ ID NO: 289 | (M)DDINNQLKRIKVIPVIAIDNAEDIIPLGKVLAENGLPAAEITERSSA AVKAIMLLRSAQPEMLIGAGTILNGVQALAAKEAGADFVVSPGENPNTVR ACQIIGIDIVPGVNNPSTVEQALEMGLTTLKFFPAEASGGISMVKSLVGP YGDIRLMPTGGITPDNIDNYLAIPQVLACGGTWMVDKKLVRNGEWDEIAR LTREIVEQVNP | I53-40B: 2, 3, 7, 9, 10, 12, 20, 21, 23, 26, 27, 30, 34, 38, 45, 60, 62, 75, 85, 94, 95, 122, 124, 126, 134, 139, 143, 151, 153, 163, 166, 167, 170, 172, 180, 184, 185, 186, 189, 190, 192, 193, 194, 195, 198, 201, 202, 205, 208, 209 |
| I53-47A.1 SEQ ID NO: 290 | (M)PIFTINTNIKADDVPSDFLSLTSRLVGLILSKPGSYVAVHINTDQQL SFGGSTNPAAFGTLMSIGGIEPDKNRDHSAVLEDHLNAMEGIPKNRMYIH FVNINGDDVGWNGTTF | I53-47A: 11, 13, 14, 17, 34, 36, 37, 45, 47, 54, 55, 56, 65, 69, 70, 71, 74, 91, 92, 93, 101, 103, 105, 109, 110, 112, 114 |
| I53-47A.1NegT2 SEQ ID NO: 292 | (M)PIFTINTNIKADDVPSDFLSLTSRLVGLILSEPGSYVAVHINTDQQL SFGGSTNPAAFGTLMSIGGIEPDKNEDHSAVLFDHLNAMLGIPKNRMYIH FVDLDGDDVGWNGTTF | I53-47A: 11, 13, 14, 17, 34, 36, 37, 45, 47, 54, 55, 56, 65, 69, 70, 71, 74, 91, 92, 93, 101, 103, 105, 109, 110, 112, 114 |
| I53-47B.1 SEQ ID NO: 291 | (M)NQHSHKDHETVRIAVVRARWHADIVDACVEAFEIAMAAIGGDREAVD VFDVPGAYEIPLHARTLAETGRYGAVLGTAFVVNGGIYRHEFVASAVIDG MMNVQLDTGVPVLSAVLTPHRYRDSDEHHRFFAARFAVKGVEAARACIEI LNARERIAA | I53-47B: 6, 7, 8, 9, 10, 11, 13, 18, 20, 21, 24, 43, 44, 51, 63, 67, 70, 85, 87, 101, 105, 122, 123, 124, 125, 126, 147, 152, 153, 154 |
| I53-47B.1NegT2 SEQ ID NO: 293 | (M)NQHSHKDHETVRIAVVRARWHADIVDACVEAFEIAMAAIGGDRFAVD VFDVPGAYEIPLHARTLAETGRYGAVLGTAFVVDGGIYDHEFVASAVIDG MMNVQLDTGVPVLSAVLTPHEYEDSDEDHEFFAAHFAVKGVEAARACIEI INAREKIAA | I53-47B: 6, 7, 8, 9, 10, 11, 13, 18, 20, 21, 24, 43, 44, 51, 63, 67, 70, 85, 87, 101, 105, 122, 123, 124, 125, 126, 147, 152, 153, 154 |
| I53-50A.1 SEQ ID NO: 294 | (M)KMEELFKKHKIVAVLRANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKLGHDILKLFPGEVVGPQFVKAMGPF PNVKFVPTGGVNLDNVCEWFKAGVLAVGVGDALVKGDPDEVREKAKKEVE KIRGCTE | I53-50A: 4, 5, 6, 8, 9, 11, 17, 19, 23, 37, 46, 47, 59, 74, 77, 78, 81, 94, 95, 98, 101, 102, 103, 106, 119, 122, 126, 139, 142, 145, 149, 150, 152, 160, 161, 162, 163, 166, 169, 179, 183, 185, 188, 191, 192, 194, 198, 199 |
| I53-50A.1NegT2 SEQ ID NO: 296 | (M)KMEELFKKHKIVAVIRANSVEEAIEKAVAVFAGGVHLIEITFTVPDA DTVIKALSVLKEKGAIIGAGTVTSVEQCRKAVESGAEFIVSPALDEEISQ FCKEKGVFYMPGVMTPTELVKAMKLGHDILKLFPGEVVGPEFVEAMKGPF PNVKFVPTGGVDLDDVCEWFDAGVLAVGVGDALVEGDPDEVREDAKEFVE EIRGCTE | I53-50A: 4, 5, 6, 8, 9, 11, 17, 19, 23, 37, 46, 47, 59, 74, 77, 78, 81, 94, 95, 98, 101, 102, 103, 106, 119, 122, 126, 139, 142, 145, 149, 150, 152, 160, 161, 162, 163, 166, 169, 179, 183, 185, 188, 191, 192, 194, 198, 199 |

TABLE 4-continued

| Name | Amino Acid Sequence | Surface residues not near interface |
|---|---|---|
| I53-50A.1PosT1 SEQ ID NO: 298 | (M)KMEELFKKHKIVAVLRANSVEEAIEKAVAVFAGGVHLIEITFTVPDA DTVIKALSVLKEKGAIIGAGTVTSVEQCRKAVESGAEFIVSPHLDEEISQ FCKEKGVFYMPGVMTPTELVKAMKLGHDILKLFPGEVVGPQFVKAMGPE PNVKFVPTGGVNLDNVCKWFKAGVLAVGVGKALVKGKPDEVREKAKKFVK KIRGCTE | I53-50A: 4, 5, 6, 8, 9, 11, 17, 19, 23, 37, 46, 47, 59, 74, 77, 78, 81, 94, 95, 98, 101, 102, 103, 106, 119, 122, 126, 139, 142, 145, 149, 150, 152, 160, 161, 162, 163, 166, 169, 179, 183, 185, 188, 191, 192, 194, 198, 199 |
| I53-50B.1 SEQ ID NO: 295 | (M)NQHSHKDHETVRIAVVRARWHAEIVDACVSAFEAAMRDIGGDREAVD VFDVPGAYEIPLHARTLAETGRYGAVLGTAFVVNGGIYRHEFVASAVIDG MMNVQLDTGVPVLSAVLTPHRYRDSDAHTLLFLALFAVKGMEAARACVEI LAAREKIAA | I53-50B: 6, 7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53-50B.1NegT2 SEQ ID NO: 297 | (M)NQHSHKDHETVRIAVVPARWHAEIVDACVSAFEAAMRDIGGDREAVD VFDVPGAYEIPLHARTLAETGRYGAVLGTAFVVDGGIYDHEFVASAVIDG MMNVQLDTGVPVLSAVLTPHEYEDSDADTLLFLALFAVKGMEAARACVEI LAAREKIAA | I53-50B; 6, 7, 8, 9, 10, 11, 13, 18, 20, 21, 34, 38, 39, 40, 43, 44, 48, 51, 63, 67, 70, 87, 101, 105, 118, 143, 147, 152, 153, 154 |
| I53_dn5A (SEQ ID NO: 41) | MGKYDGSKERIGILHARWNAEIILALVLGALKRLQEFGVKRENIIIETVP GSFELPYGSKLFVEKQKREGKPLDAIIPIGVLIKGSTMHFEYICDSTTHQ LMKLNFELGIPVIFGVLTCLTDEQAEARAGLIEGKMHNHGEDWGAAAVEM ATKFN | I53_dn5A: 5, 7, 8, 32, 33, 35, 36, 40, 42, 60, 64-72, 84, 86, 88, 120, 121, 122, 123, 126. 131-136, 141, 142, 155 |
| I53_dn5 B (SEQ ID NO: 89) | EEAELAYLLGELAYKLGEYRIAIRAYRIALKRDPNNAEAWYNIGNAYYKQ GRYREAIEYYQKALELDPNNAEAWYNLGNAYYERGEYEEAIEYYRKALRE DPNNADAMQNLLNAKMREE | I53 dn5B: 7, 14, 35, 38, 41, 42, 45, 47, 48, 49, 55, 58, 61, 62, 65, 69, 72, 75, 76, 79, 81, 82, 89, 92, 96, 110, 113 |
| I53_dn5 A.1 (A_LF4_ W16G) SEQ ID NO: 43 | MGKYDGSKLRIGILHARGNAEIILALVLGALKRLQEFGVKRENIIIETVP GSFELPYGSKLEVEKQKRLGKPLDAIIPIGVLIRGSTPHEDYIADSTTHQ LMKINFELGIPVIFGVITADTDEQAEARAGLIEGKMHNHGEDWGAAAVEM ATKEN | I53_dn5A: 5, 7, 8, 32, 33, 35, 36, 40, 42, 60, 64-72, 84, 86, 88, 120, 121, 122, 123, 126, 131-136, 141, 142, 155 |
| I53_dn5 A.2 (A_LF2_ W16G_LS) SEQ ID NO: 45 | MGKYDGSKLRIGILHARGNAEIILALVLGALKRLQEFGVKRENIIIETVP GSFELPYGSKLFVEKQKRKGEPLDAIIPIGVLIRGSTAHFDYIADSTTHQ LMKLNFELGIPVIFGVLTTESDEQAEERAGTKAGNHGEDWGAAAVEMATK FN | I53_dn5A: 5, 7, 8, 32, 33, 35, 36, 40, 42, 60, 64-72, 84, 86, 88, 120, 121, 122, 123, 126, 131-133, 138, 139, 152 |
| I53_dn5 A_LF2_ W16G_RS SEQ ID NO: 47 | MGKYDGSKLRIGILHARGNAEIILALVLGALKRLQEFGVKRENIIIETVP GSFELPYGSKLFVEKQKRKGEPLDAIIPIGVLIRGSTAHFDYIADSTTHQ IMKINFELGIPVIFGVLTTESDEQAEERAGLIEGKMHNHGEDWGAAAVEM ATKEN | I53_dn5A: 5, 7, 8, 32, 33, 35, 36, 40, 42, 60, 64-72, 84, 86, 88, 120, 121, 122, 123, 126, 131-136, 141, 142, 155 |
| I53_dn5 A_LF4_ W16E_LS_RS SEQ ID NO: 49 | MGKYDGSKLRIGILHARENAEIILELVLGALKRLQEFGVKRENIIIETVP GSFELPYGSKLEVEKQKRKGEPLDAIIPIGVLIRGSTPREDYIADSTTHQ LMKLNFELGIPVIFGVITADTDEQAEERAGTKAGNHGEDWGAAAVEMATK FN | I53_dn5A: 5, 7, 8, 32, 33, 35, 36, 40, 42, 60, 64-72, 84, 86, 88, 120, 121, 122, 123, 126, 131-133, 138, 139, 152 |
| I53_dn5 A_LF2_ W16G SEQ ID NO: 51 | MGKYDGSKLRIGILHARGNAEIILALVLGALKRLQEFGVKRENIIIETVP GSFELPYGSKLFVEKQKRLGKPLDAIIPIGVLIRGSTAHFDYIADSTTHQ LMKLNFELGIPVIFGVLTTESDEQAEEPAGLIEGKMANAGEDWGAAAVEM ATKN | I53_dn5A: 5, 7, 8, 32, 33, 35, 36, 40, 42, 60, 64-72, 84, 86, 88, 120, 121, 122, 123, 126, 131-136, 141, 142, 155 |
| I53_dn5 A_LF2_ W16E_LS SEQ ID NO: 53 | MGKYDGSKERIGILHARENAEIILELVLGALKRLQEFGVKRENIIIETVP GSFELPYGSKLFVEKQKRLGKPLDAIIPIGVLIRGSTAHFDYIADSTTHQ LMKINFELGIPVIFGVLTTESDEQAEERAGTKAGNHGEDWGAAAVEMATK FN | I53_dn5A: 5, 7, 8, 32, 33, 35, 36, 40, 42, 60, 64-72, 84, 86, 88, 120, 121, 122, 123, 126, 131-133, 138, 139, 152 |
| I53_dn5 W1A_LF4_ 6E SEQ ID NO: 55 | MGKYDGSKLRIGILHARENAEIILELVLGALKRLQEFGVKRENIIIETVP GSFELPYGSKLFVEKQKREGKPLDAIIPIGVLIRGSTPHFDYIADSTTHQ LMKLNFELGIPVIFGVITADTDEQAEARAGLIEGKMHNHGEDWGAAAVEM ATKEN | I53_dn5A: 5, 7, 8, 32, 33, 35, 36, 40, 42, 60, 64-72, 84, 86, 88, 120, 121, 122, 123, 126, 131-136, 141, 142, 155 |
| I53_dn5 A_LF4_ W16E_LS SEQ ID NO: 57 | MGKYDGSKLRIGILHARENAEIILELVLGALKRLQEFGVKRENIIIETVP GSFELPYGSKLFVEKQKRLGKPLDAIIPIGVLIRGSTPHEDYIADSTTHQ IMKINFELGIPVIFGVITADTDEQAEERAGTKAGNHGEDWGAAAVEMATK FN | I53_dn5A: 5, 7, 8, 32, 33, 35, 36, 40, 42, 60, 64-72, 84, 86, 88, 120, 121, 122, 123, 126, 131-133, 138, 139, 152 |
| I53_dn5 A_LF2_ | MGKYDGSKLRIGILHARENAEIILELVLGALKRLQEFGVKRENIIIETVP GSFELPYGSKLFVEKQKRKGEPLDAIIPIGVLIRGSTAHFDYIADSTTHQ | I53_dn5A: 5, 7, 8, 32, 33, 35, 36, 40, 42, 60, |

TABLE 4-continued

| Name | Amino Acid Sequence | Surface residues not near interface |
|---|---|---|
| W16E_LS_RS SEQ ID NO: 59 | LMKINFELGIPVIFGVLTTESDEQAEERAGTKAGNHGEDWGAAAVEMATK FN | 64-72, 84, 86, 88, 120, 121, 122, 123, 126, 131-133, 138, 139, 152 |
| I53-dn5 A_LF4_ W16G_RS SEQ ID NO: 61 | MGKYDGSKLRIGILHARGNAEIILALVLGALKRLQEFGVKRENIIIETVP GSFELPYGSKLEVEKQKRKGEPLDAIIPIGVLIRGSTPREDYIADSTTHQ LMKINFELGIPVIFGVITADTDEQAEARAGLIEGKMHNHGEDWGAAAVEM ATKEN | I53_dn5A: 5, 7, 8, 32, 33, 35, 36, 40, 42, 60, 64-72, 84, 86, 88, 120, 121, 122, 123, 126, 131-136, 141, 142, 155 |
| I53-dn5 A_LF2_ W16E SEQ ID NO: 63 | MGKYDGSKLRIGILHARENAEIILALVLGALKRLQEFGVKRENIIIETVP GSFELPYGSKLFVEKQKRLGKPLDAIIPIGVLIRGSTAHFDYIADSTTHQ LMKLNFELGIPVIFGVLTTESDEQAEARAGLIEGKMHNHGEDWGAAAVEM ATKEN | I53_dn5A: 5, 7, 8, 32, 33, 35, 36, 40, 42, 60, 64-72, 84, 86, 88, 120, 121, 122, 123, 126, 131-136, 141, 142, 155 |
| I53-dn5 A_LF4_ W16G_LS SEQ ID NO: 65 | MGKYDGSKERIGILHARGNAEIILELVLGALKRLQEFGVKRENIIIETVP GSFELPYGSKLFVEKQKRIGKPLDAIIPIGVLIRGSTPHEDYIADSTTHQ LMKINFELGIPVIFGVITADTDEQAEERAGTKAGNHGEDWGAAAVEMATK FN | I53_dn5A: 5, 7, 8, 32, 33, 35, 36, 40, 42, 60, 64-72, 84, 86, 88, 120, 121, 122, 123, 126, 131-133, 138, 139, 152 |
| I53-dn5 mIgK.A.2 (A_LF2_ W16G_LS) SEQ ID NO: 67 | METDTLLLWVLLLWVPGSTGDYKDEMGKYDGSKLRIGILHARGNAEIILE LVLGALKRLQEFGVKRENIIIETVPGSFELPYGSKLEVEKQKRLGKPLDA IIPIGVLIRGSTAHFDYIADSTTHQLMKENFELGIPVIFGVLTTESDEQA EERAGTKAGNHGEDWGAAAVEMATKEN | I53_dn5A: 30, 32, 33, 57, 58, 60, 61, 65, 67, 85. 89-97, 109, 111, 113, 145, 146, 147, 148, 151, 156-158, 163, 164, 177 |
| I53-dn5 mIgK.A_ LF4_W16G_ LS SEQ ID NO: 69 | METDTLLLWVLLLWVPGSTGDYKDEMGKYDGSKLRIGILHARGNAEIILE LVLGALKRLQEFGVKRENIIIETVPGSFELPYGSKLFVEKQKRLGKPLDA IIPIGVLIRGSTPHFDYIADSTTHQLMKENFELGIPVIFGVITADTDEQA EERAGTKAGNHGEDWGAAAVEMATKEN | I53_dn5A: 30, 32, 33, 57, 58, 60, 61, 65, 67, 85. 89-97, 109, 111, 113, 145, 146, 147, 148, 151, 156-158, 163, 164, 177 |
| I53-dn5 mIgK.A_ LF4_W16E_ LS SEQ ID NO: 71 | METDTLLLWVLLLWVPGSTGDYKDEMGKYDGSKLRIGILHARENAEIILE LVLGALKRLQEFGVKRENIIIETVPGSFELPYGSKLFVEKQKRLGKPLDA IIPIGVLIRGSTPHFDYIADSTTHQLMKINFELGIPVIFGVITADTDEQA EERAGTKAGNHGEDWGAAAVEMATKEN | I53_dn5A: 30, 32, 33, 57, 58, 60, 61, 65, 67, 85. 89-97, 109, 111, 113, 145, 146, 147. 148, 151, 156-158, 163, 164, 177 |
| I53-dn5 mIgK.A_ LF2_W16E_ LS SEQ ID NO: 73 | METDTLLLWVLLLWVPGSTGDYKDEMGKYDGSKLRIGILHARENAEIILE LVLGALKRLQEFGVKRENIIIETVPGSFELPYGSKLFVEKQKRLGKPLDA IIPIGVLIRGSTAHFDYIADSTTHQLMKLNFELGIPVIFGVLTTESDEQA EERAGTKAGNHGEDWGAAAVEMATKEN | I53_dn5A: 30, 32, 33, 57, 58, 60, 61, 65, 67, 85. 89-97, 109, 111, 113, 145, 146, 147, 148, 151, 156-158, 163, 164, 177 |
| I53-dn5 mIgK.A_ LF2_W16E SEQ ID NO: 75 | METDTLLLWVLLLWVPGSTGDYKDEMGKYDGSKLRIGILHARENAEIILA LVLGALKRLQEFGVKRENIIIETVPGSFELPYGSKLFVEKQKRLGKPLDA IIPIGVLIRGSTAHFDYIADSTTHQLMKINFELGIPVIFGVLTTESDEQA EARAGLIEGKMHNHGEDWGAAAVEMATKEN | I53_dn5A: 30, 32, 33, 57, 58, 60, 61, 65, 67, 85. 89-97, 109, 111, 113, 145, 146, 147, 148, 151, 156-161, 166, 167, 180 |
| I53-dn5 mIgK.A_ W16E SEQ ID NO: 77 | METDTLLLWVLLLWVPGSTGDYKDEMGKYDGSKLRIGILHARENAEIILA LVLGALKRLQEFGVKRENIIIETVPGSFELPYGSKLFVEKQKRLGKPLDA IIPIGVLIRGSTAHFDYIADSTTHQLMKINFELGIPVIFGVLTTESDEQA EARAGLIEGKMHNHGEDWGAAAVEMATKEN | I53_dn5A: 30, 32, 33, 57, 58, 60, 61, 65, 67, 85. 89-97, 109, 111, 113, 145, 146, 147, 148, 151, 156-161, 166, 167, 180 |
| I53-dn5 mIgK.A_ LF2_W16E_ LS RS SEQ ID NO: 79 | METDTLLLWVLLLWVPGSTGDYKDEMGKYDGSKLRIGILHARENAEIILE LVLGALKRLQEFGVKRENIIIETVPGSFELPYGSKLEVEKQKRKGEPLDA IIPIGVLIRGSTAHFDYIADSTTHQLMKINFELGIPVIFGVLTTESDEQA EERAGTKAGNHGEDWGAAAVEMATKEN | I53_dn5A: 30. 32, 33, 57, 58, 60, 61, 65, 67, 85. 89-97, 109, 111, 113, 145, 146, 147, 148, 151, 156-158, 163, 164, 177 |
| I53-dn5 mIgK.A_ LF4_W16E_ LS_RS SEQ ID NO: 81 | METDTLLLWVLLLWVPGSTGDYKDEMGKYDGSKLRIGILHARENAEIILE LVLGALKRLQEFGVKRENIIIETVPGSFELPYGSKLEVEKQKRKGEPLDA IIPIGVLIRGSTPHEDYIADSTTHQLMKINFELGIPVIFGVITADTDEQA EERAGTKAGNHGEDWGAAAVEMATKEN | I53_dn5A: 30, 32, 33, 57, 58, 60, 61, 65, 67, 85. 89-97, 109, 111, 113, 145, 146, 147, 148, 151, 156-158, 163, 164, 177 |
| I53-dn5 mIgK.A_ LF4_W16G_ RS SEQ ID NO: 83 | METDTLLLWVLLLWVPGSTGDYKDEMGKYDGSKLRIGILHARGNAEIILA LVLGALKRLQEFGVKRENIIIETVPGSFELPYGSKLEVEKQKRKGEPLDA IIPIGVLIRGSTPHFDYIADSTTHQLMKINFELGIPVIFGVITADTDEQA EARAGLIEGKMHNHGEDWGAAAVEMATKEN | I53_dn5A: 30, 32, 33, 57, 58, 60, 61, 65, 67, 85. 89-97, 109, 111, 113, 145, 146, 147, 148, 151, 156-161, 166, 167, 180 |

TABLE 4-continued

| Name | Amino Acid Sequence | Surface residues not near interface |
|---|---|---|
| I53-dn5 mIgK.A_ LF4_W16E SEQ ID NO: 85 | METDTLLLWVLLLWVPGSTGDYKDEMGKYDGSKLRIGILHARENAEIILA LVLGALKRLQEFGVKRENIIIETVPGSFELPYGSKLEVEKQKRLGKPLDA IIPIGVLIRGSTPHFDYIADSTTHQLMKENFELGIPVIFGVITADTDEQA EARAGLIEGKMHNHGEDWGAAAVEMATKEN | I53_dn5A: 30. 32, 33, 57, 58, 60, 61, 65, 67, 85. 89-97, 109, 111, 113, 145, 146, 147, 148, 151, 156-161, 166, 167, 180 |
| I53-dn5 mIgK.A_ LF2_W16G_ RS SEQ ID NO: 87 | METDTLLLWVLLLWVPGSTGDYKDEMGKYDGSKLRIGILHARGNAEIILA LVLGALKRLQEFGVKRENIIIETVPGSFELPYGSKLEVEKQKRKGEPLDA IIPIGVLIRGSTAHFDYIADSTTHQLMKINFELGIPVIFGVLTTESDEQA EARAGLIEGKMHNAGEDWGAAAVEMATKEN | I53_dn5A: 30, 32, 33, 57, 58, 60, 61, 65, 67, 85, 89-97, 109, 111, 113, 145, 146, 147, 148, 151, 156-161, 166, 167, 180 |
| I53-dn5 mIgK-mod.A.2 (A_LF2_W16G_LS) SEQ ID NO: 347 | METDTLLLWVLLLWVPGSTGDKYDGSKLRIGILHARGNAEIILELVLGAL KRLQEFGVKRENIIIETVPGSFELPYGSKLFVEKQKRLGKPLDAIIPIGV LIRGSTAHFDYIADSTTHQLMKLNFELGIPVIFGVITTESDEQAEERAGT KAGNHGEDWGAAAVEMATKEN | I53_dn5A: 24, 26, 27, 51, 52, 54, 55, 59, 61, 79, 83-91, 103, 105, 107, 139, 140, 141, 142, 145, 150-152, 157, 158, 171 |
| I53-dn5 Prolactin.A LF4_W16E SEQ ID NO: 348 | MDSKGSSQKGSRLLLLLVVSNLLLPQGVLAKYDGSKLRIGILHARENAEI ILALVLGALKRLQEFGVKRENIIIETVPGSFELPYGSKLFVEKQKRLGKP LDAIIPIGVLIRGSTPHFDYIADSTTHQLMKINFELGIPVIFGVITADTD EQAEARAGLIEGKMHNHGEDWGAAAVEMATKEN | I53_dn5A: 33, 35, 36, 60, 61, 63, 64, 68, 70, 88, 92-100, 112, 114, 116, 148, 149, 150, 151, 154, 159-164, 169, 170, 183 |
| I53-dn5 Prolactin.A (A_LF2_W16G_LS) SEQ ID NO: 349 | MDSKGSSQKGSRLLLLLVVSNLLLPQGVLAKYDGSKLRIGILHARGNAEI ILELVLGALKRLQEFGVKRENIIIETVPGSFELPYGSKLEVEKQKRLGKP LDAIIPIGVLIRGSTAHFDYIADSTTHQLMKLNFELGIPVIFGVLTTESD EQAEERAGTKAGNHGEDWGAAAVEMATKEN | I53_dn5A: 33, 35, 36, 60, 61, 63, 64, 68, 70, 88, 92-100, 112, 114, 116, 148, 149, 150, 151, 154, 159-161, 166, 167, 180 |

To produce the self-assembling nanoparticles of the disclosure, first and second proteins may be expressed and purified independently. In this non-limiting example, as depicted in FIG. 1A, mixing of the first and second proteins in vitro initiates the assembly of HA-bearing nanoparticles. Alternatively, the first and second proteins, including second proteins joined to an immunogenic portion of an HA protein, could be co-expressed in the same cell. In such a system, co-expression of the first and second proteins would result in formation of the nanoparticles inside the cell, and/or during purification from the cell.

As noted above, nanoparticles of the disclosure comprise at least one second assembly that comprises a second protein joined to an immunogenic portion of an influenza HA protein. Such a protein may be referred to as a fusion protein. As used herein, a fusion protein is a protein in which two or more amino acid sequences have been covalently joined together to produce a new, contiguous amino acid sequence that is not naturally occurring, and is therefore made by the hand of man. It should be understood that because fusion proteins of the disclosure comprise the sequence of a second protein of the disclosure, fusion proteins can self-assemble, thereby forming second assemblies of the disclosure, such a second assembly comprising the immunogenic portion of the HA protein. Thus, a protein comprising a second protein joined to an immunogenic portion of an HA protein is an example of a fusion protein. The immunogenic portion of the HA protein may be joined to either the amino end of the second protein or the carboxy end of the second protein, as long as a nanoparticle containing a second assembly comprising the fusion protein displays the immunogenic portion of the HA protein on its exterior surface.

In these fusion proteins, the second protein may be joined directly to the immunogenic portion of the influenza HA protein, or the second protein and the immunogenic portion of the influenza HA protein may be joined using a linker. As used throughout this disclosure, a linker (linker sequence, linker peptide, and the like) is a short (e.g., 2-20) amino acid sequence used to covalently join two amino acid sequences (proteins) having a desired characteristic (e.g., structure, the ability to self-assemble, the ability to elicit an immune response, epitope, immunogenicity, an activity, etc.). Preferably, linkers are about 2, 3, 4, 5, 6, 7, 8, 9, 10, 12, 14, 16, 18 or 20 amino acid residues in length. A linker sequence typically does not have its own activity and is usually used to allow other parts of the protein construct to assume a desired conformation or orientation. Linker sequences are typically made from small amino acid residues and/or runs thereof, such as serine (S), alanine (A), and glycine (G), although the use of other amino acid residues is not excluded. For example, a proline (P) residue may be used in linkers of this disclosure. Examples of linkers useful for practicing this disclosure include, but are not limited to, GSGSG (SEQ ID NO:337). GG, GGG, PPG, GPPG (SEQ ID NO:338), and GGSGGSGS (SEQ ID NO:339).

It should be understood that each second assembly may comprise more than one fusion protein; i.e., more than one type of HA protein immunogenic portion joined to second proteins to form the fusion proteins. In fact, each second assembly may comprise any number of fusion proteins, up to the number of second proteins in the second assembly. For example, if a second assembly is made from three second proteins, such an assembly may comprise one, two, or three fusion proteins, each such fusion protein comprising a second protein being joined to an immunogenic portion of an HA protein. Such immunogenic portions may, or may not, be from the same HA protein (i.e., from an HA protein from the same Type, Group, subtype, or strain of influenza virus; and/or different immunogenic portions of HA proteins, such as ectodomain, head, stem, and/or stabilized stem).

Further, while all fusion proteins within an individual nanoparticle comprise second proteins having an identical sequence, different second assemblies within the same nanoparticle may comprise fusion proteins having immunogenic portions of HA proteins from different Types, Groups, subtypes, or strains of influenza virus. Thus, nanoparticles of this disclosure may comprise, and co-display, immunogenic portions of HA proteins from more than one Type, Group, subtype, or strain of influenza virus. Such a nanoparticle is referred to as a mosaic nanoparticle. A mosaic nanoparticle can comprise immunogenic portions from as many influenza HA proteins as appropriate to elicit an immune response sufficient to protect against a desired breadth of virus Types, Groups, subtypes, or strains. In various embodiments, the nanoparticle comprises immunogenic portions of HA proteins from at least two different influenza strains (i.e., a bivalent nanoparticle), or from at least three different influenza strains (i.e., a trivalent nanoparticle), or from at least four different influenza strains (i.e., a quadrivalent nanoparticle), or from at least five different influenza strains (i.e., a pentavalent nanoparticle). In one embodiment, the nanoparticle comprises immunogenic portions of HA proteins from at least six different influenza strains (hexavalent nanoparticle). In another embodiment, the nanoparticle is heptavalent or octavalent. One non-limiting example of such a combination is a nanoparticle that comprises immunogenic portions from an influenza A group 1 HA protein, an influenza A group 2 HA protein, and an influenza B HA protein. By way of non-limiting example, the nanoparticle may comprise immunogenic portions of HA proteins from an influenza H1 virus, an influenza H2 virus, an influenza H3 virus, and an influenza B virus. In another embodiment, the nanoparticle may comprise (co-display) immunogenic portions of HA proteins from influenza viruses recommended by the World Health Organization for inclusion in seasonal flu vaccines (e.g., an influenza A H1 virus, an influenza A H3 virus, an influenza B virus of the Victoria lineage, and an influenza B virus of the Yamagata lineage. In one embodiment, the nanoparticle may comprise (co-display) immunogenic portions of the HA proteins from the influenza A H1 virus, influenza A H3 virus, influenza B virus of the Victoria lineage, and influenza B virus of the Yamagata lineage.

In one embodiment, the nanoparticle displays an immunogenic portion of 3, 4, or more different HA proteins. In one embodiment, the immunogenic portion of the different HA proteins are selected from the group consisting of immunogenic portions of influenza A and influenza B HA proteins. In another embodiment, the immunogenic portion of the different HA proteins are selected from the group consisting of immunogenic portions of an H1, H2, H3, H4, H5, H6, H7, H8, H9, H10, H11, H12, H13, H14, H15, H16 H17, and H18 HA protein. In a further embodiment, the immunogenic portion of the different HA proteins comprise immunogenic portions of HA proteins from strains including but not limited to H10N4, H10N5, H10N7, H10N8, H10N9, H11N1, H11N13, H11N2, H11N4, H11N6, H11N8, H11N9, H12N1, H12N4, H12N5, H12N8, H13N2, H13N3, H13N6, H13N7, H14N5, H14N6, H15N8, H15N9, H16N3, H1N1, H1N2, H1N3, H1N6, H1N9, H2N1, H2N2, H2N3, H2N5, H2N7, H2N8, H2N9, H3N1, H3N2, H3N3, H3N4, H3N5, H3N6, H3N8, H3N9, H4N1, H4N2, H4N3, H4N4, H4N5, H4N6, H4N8, H4N9, H5N1, H5N2, H5N3, H5N4, H5N6, H5N7, H5N8, H5N9, H6N1, H6N2, H6N3, H6N4, H6N5, H6N6, H6N7, H6N8, H6N9, H7N1, H7N2, H7N3, H7N4, H7N5, H7N7, H7N8, H7N9, H8N4, H8N5, H9N1, H9N2, H9N3, H9N5, H9N6, H9N7, H9N8, and H9N9. In one embodiment, the immunogenic portion of the HA proteins comprise an immunogenic portion of each of (a) one influenza A Group 1 HA, (b) one influenza A Group 2 HA, and (c) two influenza B HAs.

In another embodiment, the immunogenic portion of the HA proteins comprise an immunogenic portion of each of (a) one H1 HA, (b) one H3 HA, and (c) one or two influenza B HAs. In a further embodiment, the immunogenic portion of the HA proteins comprise an immunogenic portion of each of (a) A/Michigan/45/2015 (H1N1), (b) A/Hong Hong/4801/2014 (H3N2), (c) B/Brisbane/60/2008 (Victoria lineage), and (d) B/Phuket/3073/2013 (Yamagata lineage). In one embodiment, the immunogenic portion of the HA proteins comprise an immunogenic portion of each of (a) A/Michigan/45/2015 (H1N1)pdm09-like virus, (b) A/Singapore/INFIMH-16-0019/2016 (H3N2)-like virus, (c) B/Colorado/06/2017-like (Victoria lineage) virus, and optionally including (d) B/Phuket/3073/2013-like (Yamagata lineage) virus. In another embodiment, the immunogenic portion of the HA proteins comprise an immunogenic portion of each of (a) A/Idaho/07/2018 (H1N1)pdm09-like virus, (b) A/Perth/1008/2019 (H3N2)-like virus (updated), (c) B/Colorado/06/2017-like (Victoria lineage) virus (updated), and optionally including (d) B/Phuket/3073/2013-like (Yamagata lineage) virus.

In another embodiment, the immunogenic portion of the HA proteins comprise an immunogenic portion of each of (a) the composition of seasonal influenza virus vaccine of 2019 (Southern hemisphere), (b) A/Michigan/45/2015 (H1N1)pdm09-like, (c) A/Singapore/INFIMH-16-0019/2016 (H3N2)-like, (d) B/Colorado/06/2017-like (Victoria lineage), and (e) B/Phuket/3073/2013-like (Yamagata lineage). In a further embodiment, the immunogenic portion of the HA proteins comprise an immunogenic potion of each of (a) the composition of seasonal influenza virus vaccine of 2020 (Southern hemisphere), (b) A/Brisbane/02/2018 (H1N1)pdm09-like, (c) A/South Australia/34/2019 (H3N2)-like, (d) B/Washington/02/2019-like (Victoria lineage), and (e) B/Phuket/3073/2013-like (Yamagata lineage)

In a further embodiment, the nanoparticle is tetrahedral, octahedral, icosahedral, dodecahedral in shape and/or symmetry. In a specific embodiment, the nanoparticle is icosahedral in shape and/or symmetry.

As an alternative to mosaic nanoparticles, a composition of the disclosure may comprise more than one species of nanoparticle of the disclosure, each species of nanoparticle displaying immunogenic portions of an HA protein from the same Type, sub-type, or strain of influenza virus, wherein different species of nanoparticle display immunogenic portions of an HA protein from a different Type, sub-type of strain of influenza virus. By way of non-limiting example, a composition may comprise a nanoparticle displaying an immunogenic portion of an HA protein from an H1 influenza virus, a nanoparticle displaying an immunogenic portion of an HA protein from an H3 influenza virus, a nanoparticle displaying an immunogenic portion of an HA protein from a first influenza B virus, and a nanoparticle displaying an immunogenic portion of an HA protein from a second influenza B virus. Such a composition may be referred to as a "cocktail". In one embodiment, a composition of the disclosure may comprise a multiplicity of nanoparticle species, each species of nanoparticle displaying an immunogenic portion of an HA protein from one influenza virus recommended by the World Health Organization for inclusion in a seasonal flu vaccine. Thus, for example, such a composition may comprise a nanoparticle displaying an immunogenic portion of an HA protein from an influenza A H1 virus, a nanoparticle displaying an immunogenic portion of an HA protein from an influenza A H3 virus, a nanoparticle displaying an immunogenic portion of an HA protein from an influenza B virus of the Victoria lineage, and a nanoparticle displaying an immunogenic portion of an HA protein from an influenza B virus of the Yamagata lineage.

As described above, nanoparticles of the disclosure comprise at least one second assembly that comprises a second protein joined to an immunogenic portion from an influenza hemagglutinin (HA) protein (i.e., a fusion protein). The immunogenic portion of the fusion protein may be derived from any influenza HA protein, so long as it elicits an immune response against one or more influenza virus Types, Groups, subtypes, or strains. As used herein, an influenza HA protein refers to a full-length influenza hemagglutinin protein, or any portion thereof, that is useful for eliciting an immune response against influenza virus (i.e., serving as an immunogen). Examples of suitable influenza HA proteins are provided in this disclosure.

Throughout this disclosure, all nomenclature used to classify influenza virus is that commonly used by those skilled in the art. Thus, a Type or Group of influenza virus refers to influenza Type A, influenza Type B, or influenza Type C. The designation of a virus as a specific Type relates to sequence differences in the respective M1 (matrix) protein or NP (nucleoprotein). Type A influenza viruses are further divided into Group 1 and Group 2. These Groups are further divided into subtypes, which refers to classification of a virus based on the sequence of its HA protein. Examples of current, commonly-recognized subtypes are H1, H2, H3, H4, H5, H6, H7, H8, H9, H10, H11, H12, H13, H14, H15. H16. H17, and H18. Group 1 influenza subtypes are H1, H2, H5, H6, H8, H9, H11, H12, H13, H16, H17, and H18. Group 2 influenza subtypes are H3, H4, H7, H10, H14, and H15. Finally, the term "strain" refers to viruses within a subtype that differ from one another in that they have small genetic variations in their genome.

Hemagglutinin proteins from different influenza viruses may have different lengths due to mutations (insertions, deletions) in the protein. Thus, reference to a corresponding region refers to a region of another HA protein that is identical, or nearly identical (e.g., at least 95%, identical, at least 98% identical, at least 99% identical, or 100% identical), in sequence, structure, and/or function to the region being compared. For example, with regard to the stem region of a hemagglutinin protein, the corresponding region in another hemagglutinin protein may not have the same residue numbers but will have a nearly identical sequence and will perform the same function. To better clarify sequence comparisons between viruses, numbering systems are used by those of skill in the art, which relate amino acid positions to a reference sequence. Unless otherwise noted, reference herein to amino acids in hemagglutinin proteins is made using the H3 numbering system. Thus, corresponding amino acid residues in hemagglutinin proteins from different strains of influenza may not have the same residue number with respect to their distance from the N-terminal amino acid of the protein. For example, using the H3 numbering system, reference to residue 100 in A/New Caledonia/20/1999 (1999 NC, H1) does not refer to the $100^{th}$ amino acid residue, counting from the N-terminal amino acid. Instead, using the H3 numbering system, residue 100 of A/New Caledonia/20/1999 (1999 NC, H1) refers to the amino acid reside in the HA from influenza 1999 NC, H1 that aligns with residue 100 of the influenza H3N2 strain. In this scenario, W93 in influenza 1999 NC, H1 aligns with W100 in H3N2 and thus, residue 93 in A/New Caledonia/20/1999 (1999 NC, H1) refers to W100.

As used herein, the terms "immunogenic," "serve as an immunogen." and the like, refer to the ability of a specific protein, or a specific region thereof, to elicit an immune response to itself, or to proteins comprising an amino acid sequence having a high degree of identity with the specific protein. According to this disclosure, two proteins having a high degree of sequence homology have amino acid sequences at least 60%, 65%, 70%, 75%, 80%, 85%, 87%, 90%, 92%, 93%, 94%, 95%, 96%, 97%, 98%, or 99% identical, or 100% identical. Methods of determining the percent identity between two amino acid or nucleic acid sequences are known in the art.

One example of an immunogenic region of an HA protein useful for eliciting an immune response is an epitope. An epitope of an influenza HA protein refers to a portion of an HA protein that may elicit an immune response against at least the homologous influenza strain, i.e., a strain from which the HA is derived. An epitope may also elicit an antibody response against a heterologous influenza strain, i.e., a Type, Group, subtype, or strain having an HA protein that is similar but not identical in sequence to that of the HA of the immunogen. The epitope preferably elicits a broadly heterosubtypic protective response. The epitope preferably elicits neutralizing antibodies.

As used herein, an immune response formed in response to a nanoparticle or vaccine of this disclosure refers to the development of a humoral and/or a cellular immune response in a subject to an influenza HA protein. For purposes of this disclosure, a "humoral immune response" refers to an immune response mediated by antibody molecules, including secretory (IgA) or IgG molecules, while a "cellular immune response" is one mediated by T-lymphocytes and/or other white blood cells. One aspect of cellular immunity involves an antigen-specific response by cytotoxic T-cells ("CTL"s). CTLs have specificity for peptide antigens that are presented in association with proteins encoded by the major histocompatibility complex (MHC) and expressed on the surfaces of cells. CTLs help induce and promote the destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide antigens in association with MHC molecules on their surface. A cellular immune response also refers to the production of cytokines, chemokines, and other such molecules produced by activated T-cells and/or other white blood cells, including those derived from CD4+ and CD8+ T-cells.

Thus, an immunological response may be one that stimulates CTLs and/or the production or activation of helper T-cells. The production of chemokines and/or cytokines may also be stimulated. Nanoparticles of this disclosure may also elicit an antibody-mediated immune response. Hence, an immunological response may include one or more of the following effects: the production of antibodies (e.g., IgA or IgG) by B-cells; and/or the activation of suppressor, cytotoxic, or helper T-cells and/or T-cells directed specifically to an influenza HA protein. These responses may serve to neutralize infectivity (e.g., antibody-dependent protection), and/or mediate antibody-complement, or antibody dependent cell cytotoxicity (ADCC) to provide protection to an immunized subject. Such responses can be determined using standard immunoassays and neutralization assays well known in the art. Preferred immunogenic portions of an HA protein for use in the nanoparticle protein constructs of this disclosure are those that elicit a broad immune response. As used herein, a broad immune response is an immune response (e.g., antibodies, T-cells, etc.) that recognizes influenza viruses of more than one Type, Group, subtype, and/or strain.

As used herein, the terms antigenic, antigenicity, and the like, refer to a protein that elicits and is bound by an antibody or a group of antibodies. Similarly, an antigenic portion of a protein is any portion that is recognized by an antibody or a group of antibodies. Recognition of an HA protein by an antibody means the antibody selectively binds to the HA protein. As used herein, the phrase "selectively binds," "selective binding," and the like, refers to the ability of an antibody to preferentially bind an HA protein as opposed to binding proteins unrelated to HA, or non-protein components in a sample or assay. An antibody that "preferentially binds" HA is one that binds HA but does not significantly bind other molecules or components that may be present in a sample or assay. Significant binding is considered, for example, binding of an anti-HA antibody to a non-HA molecule with an affinity or avidity great enough to interfere with the ability of the assay to detect and/or determine the level of anti-influenza antibodies, or HA protein, in a sample. Examples of other molecules and compounds that may be present in a sample or an assay, include but are not limited to, non-HA proteins, such as albumin, lipids and carbohydrates. As used herein, a non-HA protein is a protein having an amino acid sequence sharing less than 40% sequence homology with the sequence of an influenza HA protein disclosed herein.

As used herein, "neutralizing antibodies" are antibodies that prevent influenza virus from completing one round of replication. One round of replication refers to the life cycle of the virus, starting with attachment of the virus to a host cell and ending with budding of newly formed virus from the host cell. This life cycle includes, but is not limited to, the steps of attaching to a cell, internalization, cleavage, and rearrangement of the HA protein, fusion of the viral membrane with the endosomal membrane, release of viral ribonucleoproteins into the cytoplasm, formation of new viral particles, and budding of viral particles from the host cell membrane. A neutralizing antibody is one that inhibits one or more of such steps.

As used herein, "broadly neutralizing antibodies" are antibodies that neutralize more than one Type, Group, subtype, and/or strain of influenza virus. For example, broadly neutralizing antibodies elicited against an HA protein from a Type A influenza virus may neutralize a Type B or Type C influenza virus. As a further example, broadly neutralizing antibodies elicited against an HA protein from Group 1 influenza virus may neutralize a Group 2 influenza virus. As an additional example, broadly neutralizing antibodies elicited against an HA protein from one sub-type or strain of virus may neutralize another sub-type or strain of virus. For example, broadly neutralizing antibodies elicited against an HA protein from an H1 influenza virus may neutralize viruses from one or more sub-types such as H2, H3, H4, H5, H6, H7, H8, H8, H10, H11, H12, H13, H14, H15, H16, H17, or H18 influenza virus.

In nanoparticles of this disclosure, each second assembly comprises a plurality of second proteins, wherein at least one second assembly comprises a fusion protein comprising an identical second protein joined to an immunogenic portion of an HA protein. In various embodiments the immunogenic portion of the HA protein may comprise a full HA protein, an HA ectodomain, an HA head region, an HA stem region, a stabilized HA stem protein, immunogenic portions thereof, variations thereof (such as those described herein), and combinations thereof.

In these fusion proteins, the immunogenic portion may be from an influenza virus selected from the group consisting of Type A influenza viruses. Type B influenza viruses, and Type C influenza viruses. In these fusion proteins, the immunogenic portion of the HA protein may be from a virus selected from the group consisting of an H1, H2, H3, H4, H5, H6, H7, H8, H9, H10, H11, H12, H13, H14, H15, H16, H17, H18 influenza virus, and an influenza B lineage virus.

In these fusion proteins, the immunogenic portion of an HA protein may comprise or consist of at least 6, 8, 10, 25, 50, 75, 100, 50, 200, 250, 300, 350, 400, 450, or 500, or more contiguous amino acid residues from a sequence at least 80%, 85%, 90%, 91%, 95%, 96%, 97%, 98%, or 99% identical, or 100% identical to the sequence of an HA protein from an influenza virus selected from the group consisting of A/New Caledonia/20/1999 (1999 NC, H1), A/California/04/2009 (2009 CA, H1). A/Hong Kong/1/1968 (1968 HK, H3), A/Michigan/45/2015 (H1N1), A/Hong_Kong/4801/2014 (H3N2), A/Hong_Kong/33982/2009 (M9N2), A/Singapore/1/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu-346/2013 (H10N8), A/Michigan/45/2015 (H1N1), A/USSR/90/1977 (H1N1), A/Brevig_Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B).

The ectodomain region of an influenza HA protein comprises all amino acid residues after the secretion signal peptide to immediately before the transmembrane domain of the HA protein, or (approximately) amino acid residues 1-517 of the influenza A HA protein (H3 numbering system). One example of an ectodomain is represented by SEQ ID NO:1, which represents the ectodomain of the HA protein from influenza virus A/New Caledonia/20/1999 (H1N1). Additional examples of various HA protein ectodomains are SEQ ID NOs:4, 7, 10, 13, 16, 19, 22, 25, 28, 31, 34, and 37 of this disclosure. This list of disclosed HA protein ectodomain regions is not intended to limit this disclosure to such sequences, but is instead intended to provide guidance to one of skill in the art on the nature and structure of HA protein ectodomains, and examples of ectodomains from various influenza HA proteins. Any influenza HA protein ectodomain region may be used in practicing this disclosure.

Thus, in one embodiment, a nanoparticle of the disclosure comprises at least one second assembly comprising a fusion protein that comprises a second protein joined to an immunogenic portion of the ectodomain region of an influenza HA protein. In these fusion proteins, the immunogenic portion of the HA protein may be from an HA protein from a Type A, Type B, or Type C influenza virus. For example, the immunogenic portion may be from an HA protein from an H1, H2, H3, H4, H5, H6, H7, H8, H9, H10, H1 1, H12, H13, H14, H15, H16, H17, or H18 influenza virus. In these fusion proteins, the immunogenic portion may comprise, or consist of, at least 6, 8, 10, 25, 50, 75, 100, 50, 200, 250, 300, 350, 400, 450, or 500, or more contiguous amino acid residues from a sequence at least 80%, 85%, 90%, 91%, 95%, 96%, 97%, 98%, or 99% identical, or 100% identical to the sequence of an ectodomain region of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), A/Hong Kong/4801/2014 (H3N2), A/Hong Kong/33982/2009 (H9N2), A/Singapore/1/1957 (H2N2), A/Singapore/INFIMH-16-0019/2016, A/Indonesia/5/2005 (H5N1), A/Taiwan/2'2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B). In these fusion proteins, the immunogenic portion of an HA protein may comprise or consist of at least 6, 8, 10, 25, 50, 75, 100, 50, 200, 250, 300, 350, 400, 450, or 500, or more contiguous amino acid residues from a sequence at least 80%, 85%, 90%, 91%, 95%, 96%, 97%, 98%, or 99% identical, or 100% identical to an amino acid sequence selected from the group consisting of SEQ ID NOs:1, 4, 7, 10, 13, 16, 19, 22, 25, 28, 31, 34, and 37.

The ectodomain of the influenza HA protein is known to contain different regions or domains. Examples of such regions include the stem region and the globular head region. Nanoparticles of this disclosure may comprise a second assembly comprising a fusion protein that comprises an immunogenic portion from the head region of an influenza HA protein. The head region, which comprises (approximately) amino acid residues 52-277 of influenza A HA protein (H3 numbering system), consists exclusively of the major portion of the HA1 protein and includes two domains: the receptor binding domain (RBD) and the vestigial esterase sub-domain. One example of a globular head region is represented by amino acids 59-291 of SEQ ID NO:1, which represents the ectodomain of the HA protein from influenza virus A/New Caledonia/20/1999 (H1N1). The head region of the A/New Caledonia/20/1999 (H1N1) HA protein is represented herein as SEQ ID NO:2. Additional HA head regions useful in the protein constructs and methods of this disclosure are regions in other HA proteins that correspond to the head region of the influenza virus A/New Caledonia/20/1999 (H1N1) HA protein (i.e., regions corresponding to amino acids 59-291 of SEQ ID NO:1). Examples of head regions of various HA proteins are represented by SEQ ID NOs: 5, 8, 11, 14, 17, 20, 23, 26, 29, 32, 35, and 38 of this disclosure. This list of disclosed HA protein head regions is not intended to limit this disclosure to such sequences but is instead intended to provide guidance to one of skill in the art on the nature and structure of the head region, and examples of head regions from various influenza HA proteins. Any influenza HA protein head region may be used in practicing the invention.

Thus, in one embodiment, a nanoparticle of the disclosure comprises at least one second assembly comprising a fusion protein that comprises a second protein joined to an immunogenic portion from the head region of an influenza HA protein. In these fusion proteins, the immunogenic portion of the HA protein may be from the head region of an HA protein from a Type A, Type B, or Type C influenza virus. For example, the immunogenic portion may be from an HA protein from an H1, H2, H3, H4, H5, H6, H7, H8, H9, H10, H11, H12, H13, H14, H15, H16, H17, or H18 influenza virus. In these fusion proteins, the immunogenic portion of an HA protein may comprise, or consist of, at least 6, 8, 10, 25, 50, 75, 100, or 200, or more contiguous amino acid residues from a sequence at least 80%, 85%, 90%, 91%, 95%, 96%, 97%, 98%, or 99% identical, or 100% identical to the sequence of a head region of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), A/Hong Kong/4801/2014 (H3N2), A/Hong Kong/33982/2009 (H9N2). A/Singapore/1/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B). In these fusion proteins, the immunogenic portion of an HA protein may comprise or consist of at least 6, 8, 10, 25, 50, 75, 100, or 200, or more contiguous amino acid residues from an amino acid sequence at least 80%, 85%, 90%, 91%, 95%, 96%, 97%, 98%, or 99% identical, or 100% identical to an amino acid sequence selected from the group consisting of SEQ ID NOs:2, 5, 8, 11, 14, 17, 20, 23, 26, 29, 32, 35, and 38.

While the head region of the influenza HA protein resides entirely within the HA1 portion of the influenza HA protein, the stem region includes amino acid sequences from both the HA1 and HA2 portions. According to this disclosure, the amino acid residues that make up the stem portion of the influenza HA protein, are those amino acid residues remaining when the head region sequence is removed. For example, the stem region of the HA protein from influenza A/New Caledonia/20/1999 (1999 NC, H1) (represented by SEQ ID NO:1) is made up of amino acid residues 1-58 and amino acid residues 292-517 of SEQ ID NO: 1. In a similar manner, the stem regions from other influenza HA proteins refer to the amino acid residues in those HA proteins that correspond to amino acid residues 1-58, and amino acid residues 292-517 of the HA protein of influenza A/New Caledonia/20/1999 (1999 NC, H1), which is represented by SEQ ID NO:1. Such disclosure is not intended to limit this disclosure to the specific HA protein sequences disclosed herein, but is instead intended to provide guidance to one of skill in the art on the nature and structure of the stem region, and as an example of a stem region from an influenza HA protein. Amino acid sequences from any influenza HA protein stem region may be used in practicing this disclosure.

Thus, in one embodiment, a nanoparticle of the disclosure comprises at least one second assembly comprising a fusion protein that comprises a second protein joined to an immunogenic portion from the stem region of an influenza HA protein. In these fusion proteins, the immunogenic portion from the stem region of an HA protein may be from an HA protein from a Type A, Type B, or Type C influenza virus. For example, the immunogenic portion may be from an HA protein from an H1, H2, H3, H4, H5, H6, H7, H8, H9, H10, H11, H12, H13, H14, H15, H16, H17, or H18 influenza virus. In these fusion proteins, the immunogenic portion of the stem region of an HA protein may comprise or consist of at least 6, 8, 10, 25, 50, 75, 100, or 200, or more contiguous amino acid residues from the stem region of an HA protein comprising an amino acid sequence at least 80%, 85%, 90%, 91%, 95%, 96%, 97%, 98%, or 99% identical, or 100% identical to the sequence of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), A/Hong Kong/4801/2014 (H3N2), A/Hong Kong/33982/2009 (H9N2), A/Singapore/1/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B).

In these fusion proteins, the immunogenic portion of an HA protein may comprise or consist of at least 6, 8, 10, 25, or 50, or more contiguous amino acid residues, from a sequence that is at least 80%, 85%, 90%, 91%, 95%, 96%, 97%, 98%, or 990 identical, or 100% identical to amino acid residues 1-58 of SEQ ID NO:1, amino acid residues 1-58 of SEQ ID NO:4, amino acid residues 1-67 of SEQ ID NO:7, amino acid residues 1-68 of SEQ ID NO:10, amino acid residues 1-68 of SEQ ID NO: 13, amino acid residues 1-5 of SEQ ID NO:16, amino acid residues 1-57 of SEQ ID NO:19, amino acid residues 1-57 of SEQ ID NO:22, amino acid residues 1-59 of SEQ ID NO:25, amino acid residues 1-59 of SEQ ID NO: 28, amino acid residues 1-58 of SEQ ID NO:31, amino acid residues 1-67 of SEQ ID NO:34, or amino acid residues 1-68 of SEQ ID NO:37.

In these fusion proteins, the immunogenic portion of an HA protein may comprise or consist of at least 6, 8, 10, 25, 50, 75, 100, or 200, or more contiguous amino acid residues, from a sequence at least 80%, 85%, 90%, 91%, 95%, 96%, 97%, 98%, or 99% identical, or 100% identical to amino acid residues 292-517 of SEQ ID NO:1, amino acid residues 293-515 of SEQ ID NO:4, amino acid residues 294-517 of SEQ ID NO:7, amino acid residues 311-539 of SEQ ID NO: 10, amino acid residues 310-538 of SEQ ID NO:13, amino acid residues 289-518 of SEQ ID NO:16, amino acid residues 291-520 of SEQ ID NO:19, amino acid residues 294-523 of SEQ ID NO:22, amino acid residues 287-516 of SEQ ID NO:25, amino acid residues 287-516 of SEQ ID NO:28, amino acid residues 288-518 of SEQ ID NO:31, amino acid residues 294-525 of SEQ ID NO:34, or amino acid residues 308-537 of SEQ ID NO:37.

It is desirable for the immunogenic portion of the HA stem region used in the second assembly fusion proteins of this disclosure to assume a three-dimensional structure similar to the three-dimensional structure of the stem region observed in a wild-type influenza virus particle, or in a cell infected with an influenza virus. However, as noted above, the stem region is made from amino acid sequences that flank the head region, and thus, removal of the head region sequences de-stabilizes the three-dimensional structure of the HA protein. To overcome this problem, a fusion protein of the disclosure may comprise an immunogenic portion of an HA protein that comprises a stabilized HA stem protein (also referred to as a stabilized stem protein, a headless HA stem protein, a headless HA protein, or a stem-only HA protein), which is an influenza HA protein comprising two significant modifications. In the first modification, the head region amino acid sequences are removed, and stem region sequences flanking the head region are covalently joined together, thereby stabilizing the headless HA stem protein. In these headless constructs, the amino acid sequences flanking the removed head region may be joined directly (i.e., the amino acid residue at the carboxy end of the upstream flanking sequence is covalently linked to the amino acid residue at the amino end of the amino acid sequence immediately downstream of the head region) or through a peptide linker sequence. To exemplify and clarify this construction, the influenza A/New Caledonia/20/1999 (1999 NC, H1) virus HA protein represented by SEQ ID NO:1, could be made headless by removing amino acid residues 59-291, and then covalently linking the leucine residue at position 58 to the aspartic acid residue at position 292.

In addition to deletion of the head region, one or more mutations may be made in the stem sequence to further stabilize the headless HA protein. In particular, amino acid residues that are not directly covalently linked in the HA sequence (i.e., not near each other in the linear HA sequence; e.g., greater than 5 residues apart), but that are in close proximity in three-dimensional space in the folded, wild-type HA protein, and either do not interact or interact weakly, can be substituted with other amino acid residues to create an interaction, or to increase the strength of the interaction between the residues in the folded stabilized stem protein. For example, in the folded HA protein, the amino acid residues corresponding to K394 and E446 [K51 (HA2) and E103 (HA2)] of influenza A New Caledonia/20/1999 (H1) (corresponding to K1 and E53 of SEQ ID NO:3) form a salt bridge, helping to stabilize the folded protein. By substituting these lysine and glutamic acid residues with the appropriate amino acids, the interaction between the two amino acid residues can be strengthened, which improves the stability of the molecule and allows more extensive manipulation thereto. Similar stabilized stem proteins may be made using an HA protein from any influenza virus using the corresponding sequences and locations in the chosen HA protein. For example, the HA protein from influenza virus A/Michigan/45/2015 (H1N1), the ectodomain of which is represented by SEQ ID NO:4, could be made headless by removing amino acid residues 59-292, and then covalently linking the leucine residue at position 58 to the aspartic acid residue at position 293. Additional methods of producing stabilized stem proteins are disclosed in PCT Pat. Pub. Nos. WO/2015/183969 and WO/2018/045308, which are incorporated herein by reference.

Thus, in one embodiment, a nanoparticle of the disclosure comprises at least one second assembly comprising a fusion protein that comprises a second protein joined to influenza HA stabilized stem protein. In these fusion proteins, the immunogenic portion of the HA protein may comprise or consist of a stabilized stem protein derived from an HA protein from a Type A, Type B, or a Type C influenza virus. For example, the immunogenic portion of the HA protein in these fusion proteins may comprise or consist of a stabilized stem protein derived from an HA protein from an H1, H2, H3, H4, H5, H6, H7, H8, H9, H10, H11, H12, H13, H14, H15, H16, H17, or H18 influenza virus. As another example, the immunogenic portion of the HA protein in these fusion proteins may comprise or consist of an HA protein comprising an amino acid sequence at least 80%, 85%, 90%, 91%, 95%, 96%, 97%, 98%, or 99%/o identical, or 100% identical to the stem sequence(s) of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), Along Kong/4801/2014 (H3N2), A/Hong Kong/33982/2009 (H9N2), A/Singapore/I/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B).

In a specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-58 of SEQ ID NO:1 covalently joined, either directly or through a peptide linker, to an amino acid sequence at least 80%, 85%, 90%, 91%, 95%, 96%, 97%, 98%, or 99% identical, or 100%/o identical to amino acids 292-517 of SEQ ID NO:1, such that the stabilized stem protein lacks the amino acid sequence corresponding to amino acids 59-291 (SEQ ID NO:2).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-58 of SEQ ID NO:4 covalently joined, either directly or through a peptide linker, to an amino acid sequence at least 80%, 85%, 90%, 91%, 95%, 96%, 97%, 98%, or 99% identical, or 100% identical to amino acids 293-515 of SEQ ID NO:4, such that the stabilized stem protein lacks the amino acid sequence corresponding to amino acids 59-292 (SEQ ID NO:5).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-67 of SEQ ID NO:7 covalently joined, either directly or through a peptide linker, to an amino acid sequence at least 80%, 85%, 90%, 91%, 95%, 96%, 97%, 98%, or 99% identical, or 100% identical to amino acids 294-517 of SEQ ID NO:7, such that the stabilized stem protein lacks the amino acid sequence corresponding to amino acids 68-293 (SEQ ID NO:8).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-678 of SEQ ID NO:10 covalently joined, either directly or through a peptide linker, to an amino acid sequence at least 80%, 85%, 90%, 91%, 95%, 96%, 97%, 98%, or 99% identical, or 100% identical to amino acids 311-539 of SEQ ID NO:10, such that the stabilized stem protein lacks the amino acid sequence corresponding to amino acids 68-310 (SEQ ID NO:11).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-68 of SEQ ID NO:13 covalently joined, either directly or through a peptide linker, to an amino acid sequence at least 80%, 85%, 90%, 91%, 95%, 96%, 97%, 98%, or 99% identical, or 100% identical to amino acids 310-538 of SEQ ID NO:13, such that the stabilized stem protein lacks the amino acid sequence corresponding to amino acids 69-309 (SEQ ID NO:14).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-56 of SEQ ID NO:16 covalently joined, either directly or through a peptide linker, to an amino acid sequence at least 80%, 85%, 90%, 91%, 95%, 96%, 97%, 98%, or 99% identical, or 100% identical to amino acids 289-518 of SEQ ID NO:16, such that the stabilized stem protein lacks the amino acid sequence corresponding to amino acids 57-288 (SEQ ID NO:17).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-57 of SEQ ID NO:19 covalently joined, either directly or through a peptide linker, to an amino acid sequence at least 80%, 85%, 90%, 91%, 95%, 96%, 97%, 98%, or 99% identical, or 100% identical to amino acids 291-520 of SEQ ID NO:19, such that the stabilized stem protein lacks the amino acid sequence corresponding to amino acids 58-290 (SEQ ID NO:20).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-57 of SEQ ID NO:22 covalently joined, either directly or through a peptide linker, to an amino acid sequence at least 80%, 85%, 90%, 91%, 95%, 96%, 97%, 98%, or 99% identical, or 100% identical to amino acids 294-523 of SEQ ID NO:22, such that the stabilized stem protein lacks the amino acid sequence corresponding to amino acids 58-293 (SEQ ID NO:23).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-59 of SEQ ID NO:25 covalently joined, either directly or through a peptide linker, to an amino acid sequence at least 80%, 85%, 90%, 91%, 95%, 96%, 97%, 98%, or 99% identical, or 100% identical to amino acids 287-516 of SEQ ID NO:25, such that the stabilized stem protein lacks the amino acid sequence corresponding to amino acids 60-286 (SEQ ID NO:26).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-59 of SEQ ID NO:28 covalently joined, either directly or through a peptide linker, to an amino acid sequence at least 80%, 85%, 90%, 91%, 95%, 96%, 97%, 98%, or 99% identical, or 100% identical to amino acids 287-516 of SEQ ID NO:28, such that the stabilized stem protein lacks the amino acid sequence corresponding to amino acids 60-286 (SEQ ID NO:29).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-58 of SEQ ID NO:31 covalently joined, either directly or through a peptide linker, to an amino acid sequence at least 80%, 85%, 90%, 91%, 95%, 96%, 97%, 98%, or 99% identical, or 100% identical to amino acids 288-518 of SEQ ID NO:31, such that the stabilized stem protein lacks the amino acid sequence corresponding to amino acids 59-287 (SEQ ID NO:32).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-67 of SEQ ID NO:34 covalently joined, either directly or through a peptide linker, to an amino acid sequence at least 80%, 85%, 90%, 91%, 95%, 96%, 97%, 98%, or 99% identical, or 100% identical to amino acids 294-525 of SEQ ID NO:34, such that the stabilized stem protein lacks the amino acid sequence corresponding to amino acids 68-293 (SEQ ID NO:35).

In another specific example, the immunogenic HA portion may comprise or consist of a stabilized stem protein comprising an amino acid sequence at least 80%, 85%, 90%, 91%, 95%, 96%, 97%, 98%, or 99% identical, or 100% identical to amino acids 1-68 of SEQ ID NO:37 covalently joined, either directly or through a peptide linker, to an amino acid sequence at least 80%, 85%, 90%, 91%, 95%, 96%, 97%, 98%, or 99% identical, or 100% identical to amino acids 308-537 of SEQ ID NO:37, such that the stabilized stem protein lacks the amino acid sequence corresponding to amino acids 69-307 (SEQ ID NO:38).

In addition to lacking the head region, stabilized stem proteins described herein may also contain one or more mutations that further stabilize the stabilized HA stem protein. Thus, a second assembly fusion protein of this disclosure may comprise a stabilized HA stem protein that lacks the amino acid sequence corresponding to the HA protein head region, and the amino acid residue at the position in the stabilized stem protein that corresponds to K1 of any one of SEQ ID NOs:3, 6, 9, 18, 21, 24, 27, 30, 33, or 36, is an amino acid residue other than lysine. Alternatively or additionally, in these headless HA stem proteins, the amino acid residue at the position in the stabilized stem protein that corresponds to E53 of any one of SEQ ID NOs:3, 6, 9, 18, 21, 24, 27, 30, 33, or 36, is an amino acid other than glutamine.

In these stabilized HA stem proteins, these two substituted amino acid residues (K1 and/or E53) may individually be amino acid residues selected from the group consisting of methionine, leucine, isoleucine, and glutamine. In these stabilized HA stem proteins, these two substituted amino acid residues (K1 and/or E53) are substituted with amino acid residues that increase the strength of the interaction between these resides in the folded protein.

In addition to the deletion of the head region, and the substitution of the amino acid residue(s) at the position(s) corresponding to K1 and/or E53 of any one of SEQ ID NOs:3, 6, 9, 18, 21, 24, 27, 30, 33, or 36, as described above, stabilized stem proteins may also lack the internal loop sequence. One example of an internal loop sequence is amino acid residues 403-435 of SEQ ID NO:1. All influenza HA proteins contain an internal loop sequence that corresponds to amino acid residues 403-435 of SEQ ID NO:1. Deletion of the stem region results in the amino acid sequence flanking the internal loop sequence covalently joined (i.e., the amino acid residue at the carboxy end of the upstream flanking sequence is covalently linked to the amino acid residue at the amino end of the amino acid sequence immediately downstream of the head region). To exemplify and clarify this construction, removal of the internal loop sequence from the influenza A/New Caledonia/20/1999 (1999 NC, H1) virus HA protein represented by SEQ ID NO:1, results in the methionine at position 402 covalently linked, either directly or through a peptide linker, to the threonine amino acid residue at position 436.

Thus, a fusion protein of this disclosure may comprise an immunogenic portion of an HA protein, wherein the immunogenic portion comprises or consists of a stabilized stem protein that lacks the amino acid sequence corresponding to the HA protein head region, and the amino acid residue in the stabilized stem protein that corresponds to M402 of SEQ ID NO:1, is covalently linked, either directly or through a peptide linker, to the amino acid residue in the stabilized stem protein that corresponds to T436 of SEQ ID NO:1, such that the stabilized stem protein lacks a sequence corresponding to amino acid residues 403-435 of SEQ ID NO:1. Additionally, in these immunogenic HA fusion proteins, the amino acid residues at either one or both positions in the stabilized stem protein that correspond to K1 or E53 of any one of SEQ ID NOs:3, 6, 9, 18, 21, 24, 27, 30, 33, or 36, may be an amino acid residue other than lysine or glutamine, respectively.

Methods of making stabilized HA stem proteins, and examples of such proteins, are disclosed in International Patent Publication No. WO 2015/183969 and in International Patent Publication No. WO 2018/045308, both of which are incorporated herein in their entirety.

In one non-limiting embodiment, a nanoparticle of the disclosure comprises at least one second assembly comprising a fusion protein, the fusion protein comprising a second protein joined to an immunogenic portion of an influenza HA protein, wherein the immunogenic portion of the HA protein comprises or consists of an amino acid sequence at least 80%, 85%, 90%, 91%, 95%, 96%, 97%, 98%, or 99% identical, or 100% identical to a sequence selected from the group consisting of SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, SEQ ID NO:37, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, and SEQ ID NO:336.

In one non-limiting embodiment, the fusion protein may comprise or consist of an amino acid sequence at least 80%, 85%, 90%, 91%, 95%, 96%, 97%, 98%, or 99% identical, or 100% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:259, SEQ ID NO:261, SEQ ID NO:263, SEQ ID NO:265, and SEQ ID NOS:340-346, wherein the fusion protein non-covalently interacts to form the second assembly.

In a specific embodiment that can be combined with any embodiments herein, the fusion protein may comprise or consist of an amino acid sequence at least 80%, 85%, 90%, 91%, 95%, 96%, 97%, 98%, or 99% identical, or 100% identical to a sequence selected from the group consisting of SEQ ID NOS:340-346.

A/Brisbane/02/2018 HA 1-676 Y98F no lkr dn5B.SA
(SEQ ID NO: 340)
MKAILVVLLYTFTTANADTLCIGYHANNSTDTVDTVLEKNVTVTHSVNL
LEDKHNGKLCKLGGVAPLHLGKCNIAGWILGNPECESLSTARSWSYIVE
TSNSDNGTCFPGDFINYEELREQLSSVSSFERFEIFPKTSSWPNHDSNK
GVTAACPHAGAKSFYKNLIWLVKKGNSYPKLNQTYINDKGKEVLVLWGI
HHPPTTADQQSLYQNADAYVFVGTSRYSKKFKPEIATRPKVRDREGRMN
YYWTLVEPGDKITFEATGNLVVPRYAFTMERNAGSGIIISDTPVHDCNT
TCQTAEGAINTSLPFQNVHPVTIGKCPKYVKSTKLRLATGLRNVPSIQS
RGLFGAIAGFIEGGWTGMVDGWYGYHHQNEQGSGYAADLKSTQNAIDKI
TNKVNSVIEKMNTQFTAVGKEFNHLEKRIENLNKKVDDGFLDIWTYNAE
LLVLLENERTLDYHDSNVKNLYEKVRNQLKNNAKEIGNGCFEFYHKCDN
TCMESVKNGTYDYPKYSEEAKLNREKIDGVSAEEAELAYLLGELAYKLG
EYRIAIRAYRIALKRDPNNAEAWYNLGNAYYKQGRYREAIEYYQKALEL
DPNNAEAWYNLGNAYYERGEYEEAIEYYRKALRLDPNNADAMQNLLNAK
MREE A/Idaho/07/2018 HA 1-676 Y98F no lkr dn5B.SA
(SEQ ID NO: 341)
MKAILVVLLYTFTTANADTLCIGYHANNSTDTVDTVLEKNVTVTHSVNL
LEDKHNGKLCKLRGVAPLHLGKCNIAGWILGNPECESLSTARSWSYIVE
TSNSDNGTCFPGDFINYEELREQLSSVSSFERFEIFPKTSSWPNHDSNK
GVTAACPHAGAKSFYKNLIWLVKKGNSYPKLNQTYINDKGKEVLVLWGI
HHPPTTADQQSLYQNADAYVFVGTSRYSKKFKPEIATRPKVRDQEGRMN
YYWTIVEPGDKITFEATGNLVVPRYAFTMERNAGSGIIISDTPVHDCNT
TCQTPEGAINTSLPFQNVHPITIGKCPKYVKSTKLRLATGLRNVPSIQS
RGLFGAIAGFIEGGWTGMVDGWYGYHHQNEQGSGYAADLKSTQNAIDKI
TNKVNSVIEKMNTQFTAVGKEFNHLEKRIENLNKKVDDGELDIWTYNAE
LLVLLENERTLDYHDSNVKNLYEKVRNQLKNNAKEIGNGCFEFYHKCDN
TCMESVKNGTYDYPKYSEEAKLNREKIDGVSAEEAELAYLLGELAYKLG
EYRIAIRAYRIALKRDPNNAEAWYNLGNAYYKQGRYREAIEYYQKALEL
DPNNAEAWYNLGNAYYERGEYEEAIEYYRKALRLDPNNADAMQNLLNAK
MREE A/Switzerland/3330/2017 HA 1-676 Y98F no lkr
dn5B.SA
(SEQ ID NO: 342)
MKAILVVLLYTFTTANADTLCIGYHANNSTDTVDTVLEKNVTVTHSVNL
LEDKHNGKLCKLRGVAPLHLGKCNIAGWILGNPECESLSTARSWSYIVE
TSNSDNGTCFPGDFINYEELREQLSSVSSFERFEIFPKTSSWPNHDSNK
GVTAACPHAGAKSFYKNLIWLVKKGNSYPKLNQTYINDKGKEVLVLWGI
HHPPTTADQQSLYQNADAYVFVGTSRYSKKFKPEIATRPKVRDQEGRMN
YYWTLVDPGDKITFEATGNLVVPRYAFTMERDAGSGIIISDTPVHDCNT
TCQTPEGAINTSLPFQNVHPITIGKCPKYVKSTKLRLATGLRNVPSIQS
RGLFGAIAGFIEGGWTGMVDGWYGYHHQNEQGSGYAADLKSTQNAIDKI
TNKVNSVIEKMNTQFTAVGKEFNHLEKRIENLNKKVDDGELDIWTYNAE
LLVLLENERTLDYHDSNVKNLYEKVRNQLKNNAKEIGNGCFEFYHKCDN
TCMESVKNGTYDYPKYSEEAKLNREKIDGVSAEEAELAYLLGELAYKLG
EYRIAIRAYRIALKRDPNNAEAWYNLGNAYYKQGRYREAIEYYQKALEL
DPNNAEAWYNLGNAYYERGEYEEAIEYYRKALRLDPNNADAMQNLLNAK
MREE A/Perth/1008/2019 HA 1-676 Y98F GG dn5B.SA
(SEQ ID NO: 343)
MKTIIALSYILCLVFAQKIPGNDNSTATLCLGHHAVPNGTIVKTITNDR
IEVTNATELVQNSSIGEICDSPHQILDGGNCTLIDALLGDPQCDGFQNK
KWDLFVERSRAYSNCFPYDVPDYASLRSIVASSGTLEFKNESENWAGVK
QNGTSSACIRGSSSSFFSRLNWLTHLNYTYPALNVTMPNKEQFDKLYIW
GVHHPGTDKDQIFLYARSSGRITVSTRRSQQAVIPNIGFRPRIRDIPSR
ISIYWTIVKPGDILLINSTGNLIAPRGYFKIRSGKSSIMRSDAPIGKCK
SECITPNGSIPNDKPFQNVNRITYGACPRYVKQSTLKLATGMRNVPEKQ
TRGIFGAIAGFIENGWEGMMDGWYGFRHQNSEGRGQAADLKSTQAAIDQ
INGKLNRLIGKTNEKFHQIEKEFSEVEGRVQDLEKYVEDTKIDLWSYNA
ELLVALENQHTIDLTDSEMNKLFEKTKKQLRENAEDMGNGCFKIYHKCD
NACIGSIRNGTYDHNVYRDEALNNRFQIKGVGGSAEEAELAYLLGELAY
KLGEYRIAIRAYRIALKRDPNNAEAWYNLGNAYYKQGRYREAIEYYQKA
LELDPNNAEAWYNLGNAYYERGEYEEAIEYYRKALRLDPNNADAMQNLL
NAKMREE A/Wisconsin/549/2019 HA 1-676 Y98F GG dn5B.SA
(SEQ ID NO: 344)
MKTIIALSCILCLVFAQKIPGNDNSTATLCLGHHAVPNGTIVKTITNDR
IEVTNATELVQNSSIGEICDSPHQILDGENCTLIDALLGDPQCDGFQNK
KWDLFVERNKAYSNCFPYDVPDYASLRSLVASSGTLEFNNESFNWAGVT
QNGKSSSCIRGSKSSFFSRLNWITHLNSKYPALNVTMPNNEQFDKLYIW
GVHHPGTDKDQISLYAQSSGRITVSTKRSQQAVIPNIGFRPRIRDIPSR
ISIYWTIVKPGDILLINSTGNLIAPRGYFKIRSGKSSIMRSDAPIGKCK
SECITPNGSIPNDKPFQNVNRITYGACPRYVKQSTLKLATGMRNVPERQ
TRGIFGAIAGFIENGWEGLVDGWYGFRHQNSEGRGQAADLKSTQAAIDQ
INGKLNRLIGKTNEKFHQIEKEFSEVEGRIQDLEKYVEDTKIDLWSYNA
ELLVALENQHTIDLTDSEMNKLFEKTKKQLRENAEDVGNGCFKIYHKCD -continued
NACMGSIRNGTYDHNVYRDEALNNRFQIKGVGGSAEEAELAYLLGELAY
KLGEYRIAIRAYRIALKRDPNNAEAWYNLGNAYYKQGRYREAIEYYQKA
LELDPNNAEAWYNLGNAYYERGEYEEAIEYYRKALRLDPNNADAMQNLL
NAKMREE B/Colorado/06/2017 HA 1-674 no lkr dn5B.SA
(SEQ ID NO: 345)
MKAIIVLLMVVTSSADRICTGITSSNSPHVVKTATQGEVNVTGVIPLTT
TPTKSHFANLKGTETRGKLCPKCLNCTDLDVALGRPKCTGKIPSARVSI
LHEVRPVTSGCFPIMHDRTKIRQLPNLLRGYEHVRLSTHNVINAEGAPG
GPYKIGTSGSCPNITNGNGFFATMAWAVPDKNKTATNPLTIEVPYVCTE
GEDQITVWGFHSDNETQMAKLYGDSKPQKFTSSANGVTTHYVSQIGGFP
NQTEDGGLPQSGRIVVDYMVQKSGKTGTITYQRGILLPQKVWCASGRSK
VIKGSLPLIGEADCLHEKYGGLNKSKPYYTGEHAKAIGNCPIWVKTPLK
LANGTKYRPPAKLLKERGFFGAIAGFLEGGWEGMIAGWHGYTSHGAHGV
AVAADLKSTQEAINKITKNLNSLSELEVKNLQRLSGAMDELHNEILELD
EKVDDLRADTISSQIELAVLLSNEGIINSEDEHLLALERKLKKMLGPSA
VEIGNGCFETKHKCNQTCLDKIAAGTEDAGEFSLPTFDSLNITAASAEE
AELAYLLGELAYKLGEYRIAIRAYRIALKRDPNNAEAWYNLGNAYYKQG
RYREAIEYYQKALELDPNNAEAWYNLGNAYYERGEYEEAIEYYRKALRL
DPNNADAMQNLLNAKMREE B/Phuket/3073/2013 HA 1-674 no lkr dn5B.SA
(SEQ ID NO: 346)
MKAIIVLLMVVTSNADRICTGITSSNSPHVVKTATQGEVNVTGVIPLTT
TPTKSYFANLKGTRTRGKLCPDCLNCTDLDVALGRPMCVGTTPSAKASI
LHEVRPVTSGCFPIMHDRTKIRQLPNLLRGYEKIRLSTQNVIDAEKAPG
GPYRLGTSGSCPNATSKIGFFATMAWAVPKDNYKNATNPLTVEVPYICT
EGEDQITVWGFHSDNKTQMKSLYGDSNPQKFTSSANGVTTHYVSQIGDF
PDQTEDGGLPQSGRIVVDYMMQKPGKTGTIVYQRGVLLPQKVWCASGRS
KVIKGSLPLIGEADCLHEEYGGLNKSKPYYTGKHAKAIGNCPIWVKTPL
KLANGTKYRPPAKLLKERGFFGAIAGFLEGGWEGMIAGWHGYTSHGAHG
VAVAADLKSTQEAINKITKNINSLSELEVKNLQRLSGAMDELHNEILEL
DEKVDDLRADTISSQIELAVLLSNEGIINSEDEHLLALERKLKKMLGPS
AVDIGNGCFETKHKCNQTCLDRIAAGTFNAGEFSLPTFDSLNITAASAE
EAELAYLIGELAYKLGEYRIAIRAYRIALKRDPNNAEAWYNLGNAYYKQ
GRYREAIEYYQKALELDPNNAEAWYNLGNAYYERGEYEEAIEYYRKALR
LDPNNADAMQNLLNAKMREE In one non-limiting embodiment, the nanoparticle, comprises.

(a) a plurality of first assemblies, each first assembly comprising a plurality of identical first proteins;

(b) a plurality of second assemblies, each second assembly comprising a plurality of identical second proteins;

wherein each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:32, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:347, SEQ ID NO:348, and SEQ ID NO:349, wherein the plurality of identical first proteins non-covalently interact to form a first assembly;

wherein each second protein comprises, or consists of, amino acid sequence is at least 80%, 85%, 90%, 91%, 95%, 96%, 97%, 98%, or 99% identical, or 100% identical to SEQ ID NO:89, wherein a plurality of second proteins non-covalently interact to form a second assembly;

wherein at least one second assembly comprises a second protein joined to the ectodomain of an influenza HA protein, thereby forming a fusion protein;

wherein the plurality of first assemblies non-covalently interact with the plurality of second assemblies to form the nanoparticle; and wherein the nanoparticle displays the influenza HA protein ectodomain on the exterior surface of the nanostructure.

In these nanoparticles, the ectodomain may comprise, or consists of, an amino acid sequence is at least 80%, 85%, 90%, 91%, 95%, 96%, 97%, 98%, or 99% identical, or 100% identical to a sequence selected from the group consisting of SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, and SEQ ID NO:37.

In these nanoparticles, the fusion protein may comprise, or consists of, an amino acid sequence is at least 80%, 85%, 90%, 91%, 95%, 96%, 97%, 98%, or 99% identical, or 1000% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO: 117, SEQ ID NO: 119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, and SEQ ID NOS:340-346.

Another embodiment is a nanoparticle, comprising:
(a) a plurality of first assemblies, each first assembly comprising a plurality of identical first proteins;
(b) a plurality of second assemblies, each second assembly comprising a plurality of identical second proteins;
wherein each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:227, SEQ ID NO:229 SEQ ID NO:231, SEQ ID NO:233, SEQ ID NO:235, SEQ ID NO:237, SEQ ID NO:239, SEQ ID NO:241, and SEQ ID NO:243, wherein the plurality of identical first proteins non-covalently interact to form the first assembly;
wherein each second protein comprises, or consists of, amino acid sequence is at least 80%, 85%, 90%, 91%, 95%, 96%, 97%, 98%, or 99% identical, or 100% identical to a sequence selected from the group consisting of SEQ ID NO:245, SEQ ID NO:247, SEQ ID NO:249, SEQ ID NO:251, SEQ ID NO:253, SEQ ID NO:255, and SEQ ID NO:257;
wherein at least one second assembly comprises a second protein joined to the ectodomain of an influenza HA protein, thereby forming a fusion protein;
wherein the plurality of first assemblies non-covalently interact with the plurality of second assemblies to form the nanoparticle; and
wherein the nanoparticle displays the influenza HA protein ectodomain on the exterior surface of the nanostructure.

In these nanoparticles, the ectodomain may comprise, or consists of, an amino acid sequence is at least 80%, 85%, 90%, 91%, 95%, 96%, 97%, 98%, or 99% identical, or 100% identical to a sequence selected from the group consisting of SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, and SEQ ID NO:37.

In these nanoparticles, the fusion protein may comprise, or consists of, an amino acid sequence at least 80%, 85%, 90%, 91%, 95%, 96%, 97%, 98%, or 99% identical, or 100% identical to a sequence selected from the group consisting of SEQ ID NO:259, SEQ ID NO:261, SEQ ID NO:263, SEQ ID NO:265, wherein the plurality of fusion proteins interact to form the second assembly.

One embodiment of this disclosure is a nanoparticle comprising a plurality of first assemblies, each first assembly comprising a plurality of identical first proteins; and a plurality of second assemblies, each second assembly comprising a plurality of identical second proteins, wherein the first protein and the second proteins comprise, or consist of, amino acid sequences at least 80%, 85%, 90%, 91%, 95%, 96%, 97%, 98%, or 99% identical, or 100% identical, to the sequences of first and second proteins, respectively, selected from the pairs of first and second proteins in Table 2, wherein at least one second assembly comprises a second protein joined to the ectodomain of an influenza hemagglutinin (HA) protein, thereby forming a fusion protein. In these nanoparticles, the ectodomain may comprise, or consists of, an amino acid sequence is at least 80%, 85%, 90%, 91%, 95%, 96%, 97%, 98%, or 99% identical, or 100% identical to a sequence selected from the group consisting of SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, and SEQ ID NO:37.

One embodiment of this disclosure is a nanoparticle, comprising:
(a) a plurality of first assemblies, each first assembly comprising a plurality of identical first proteins;
(b) a plurality of second assemblies, each second assembly comprising a plurality of identical second proteins:
wherein each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:32, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, and SEQ ID NO:87, SEQ ID NO:347, SEQ ID NO:348, and SEQ ID NO:349, wherein the plurality of identical first proteins non-covalently interact to form the first assembly;
wherein each second protein comprises, or consists of, amino acid sequence is at least 80%, 85%, 90%, 91%, 95%, 96%, 97%, 98%, or 99% identical, or 100% identical to SEQ ID NO:89, wherein a plurality of second proteins non-covalently interact to form the second assembly;
wherein at least one second assembly comprises a second protein joined to an influenza HA stabilized stem protein, thereby forming a fusion protein;
wherein the plurality of first assemblies non-covalently interact with the plurality of second assemblies to form the nanoparticle; and wherein the nanoparticle displays the influenza HA stabilized stem on the exterior surface of the nanostructure.

In these nanoparticles, the stabilized stem protein may comprise, or consist of, an amino acid sequence is at least 80%, 85%, 90%, 91%, 95%, 96%, 97%, 98%, or 99% identical, or 100% identical to a sequence selected from the group consisting of SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, SEQ ID NO:336.

In these nanoparticles, the fusion protein may comprise, or consist of, an amino acid sequence at least 80%, 85%, 90%, 91%, 95%, 96%, 97%, 98%, or 99% identical, or 100% identical to a sequence selected from the group consisting of SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, and SEQ ID NO:225, wherein the plurality of fusion proteins non-covalently interact to form the second assembly.

One embodiment of this disclosure is a nanoparticle, comprising:
(a) a plurality of first assemblies, each first assembly comprising a plurality of identical first proteins;
(b) a plurality of second assemblies, each second assembly comprising a plurality of identical second proteins:
   wherein each first protein comprises, or consists of, an amino acid sequence at least 80%, 85%, 90%, 91%, 95%, 96%, 97%, 98%, or 99% identical, or 100% identical to a sequence selected from the group consisting of SEQ ID NO:227, SEQ ID NO:229 SEQ ID NO:231, SEQ ID NO:233, SEQ ID NO:235, SEQ ID NO:237, SEQ ID NO:239, SEQ ID NO:241, and SEQ ID NO:243, wherein the plurality of first proteins non-covalently interact to form the first assembly;
   wherein each second protein comprises, or consists of, amino acid sequence is at least 80%, 85%, 90%, 91%, 95%, 96%, 97%, 98%, or 99% identical, or 100% identical to a sequence selected from the group consisting of SEQ ID NO:245, SEQ ID NO:247, SEQ ID NO:249, SEQ ID NO:251, SEQ ID NO:253, SEQ ID NO:255, and SEQ ID NO:257;
   wherein at least one second assembly comprises a second protein joined to an influenza HA stabilized stem protein, thereby forming a fusion protein;
   wherein the plurality of first assemblies non-covalently interact with the plurality of second assemblies to form the nanoparticle; and
   wherein the nanoparticle displays the influenza HA stabilized stem on the exterior surface of the nanostructure.

In these nanoparticles, the stabilized stem protein may comprise, or consist of, an amino acid sequence is at least 80%, 85%, 90%, 91%, 95%, 96%, 97%, 98%, or 99% identical, or 100% identical to a sequence selected from the group consisting of SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, SEQ ID NO:336.

One embodiment of this disclosure is a nanoparticle comprising a plurality of first assemblies, each first assembly comprising a plurality of identical first proteins; and a plurality of second assemblies, each second assembly comprising a plurality of identical second proteins, wherein the first protein and the second proteins comprise, or consist of, amino acid sequences at least 80%, 85%, 90%, 91%, 95%, 96%, 97%, 98%, or 99% identical, or 100% identical, to the sequences of first and second proteins, respectively, selected from the pairs of first and second proteins in Table 2, wherein at least one second assembly comprises a second protein joined to an influenza HA stabilized stem protein, thereby forming a fusion protein. In these nanoparticles, the stabilized stem protein may comprise, or consist of, an amino acid sequence is at least 80%, 85%, 90%, 91%, 95%, 96%, 97%, 98%, or 99% identical, or 100% identical to a sequence selected from the group consisting of SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, SEQ ID NO:336.

One embodiment of this disclosure is a fusion protein comprising, or consisting of, an amino acid sequence at least 80%, 85%, 90%, 91%, 95%, 96%, 97%, 98%, or 99% identical, or 100% identical to SEQ ID NO:89; joined to an immunogenic portion of an influenza virus HA protein.

One embodiment of this disclosure is a protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:245, SEQ ID NO:247, SEQ ID NO:249, SEQ ID NO:251, SEQ ID NO:253, SEQ ID NO:255, and SEQ ID NO:257; joined to an immunogenic portion of an influenza virus HA protein.

In these proteins comprising the amino acid sequence of a second protein of the disclosure joined to an immunogenic portion of an influenza HA protein, the immunogenic portion can be an immunogenic portion from an HA protein from any influenza virus. Thus, in one embodiment, the immunogenic portion comprises or consists of at least 6, 8, 10, 25, 50, 75, 100, 200, 300, or 400 contiguous amino acid residues from an HA protein comprising an amino acid sequence at least 80%, 85%, 90%, 91%, 95%, 96%, 97%, 98%, or 99% identical, or 100% identical to the sequence of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), A/Hong Kong/4801/2014 (H3N2), A/Hong Kong/33982/2009 (H9N2), A/Singapore/1/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B).

One embodiment of this disclosure is a protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113. SEQ ID NO: 115, SEQ ID NO:117, SEQ ID NO: 119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, and SEQ ID NO:225.

One embodiment of this disclosure is a protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:259, SEQ ID NO:261, SEQ ID NO:263, and SEQ ID NO:265.

Proteins of this disclosure are encoded by nucleic acid molecules of this disclosure. These nucleic acid molecules comprise a nucleic acid sequence that encodes a protein of this disclosure. A nucleic acid molecule can be produced recombinantly, synthetically, or by a combination of recombinant and synthetic procedures. A nucleic acid molecule of the disclosure can have a wild-type nucleic acid sequence or a codon-modified nucleic acid sequence that may for example, incorporate codons better recognized by the human translation system. A nucleic acid molecule may also be genetically-engineered to introduce or eliminate codons encoding different amino acids, such as to introduce codons that encode an N-linked glycosylation site. Methods to produce nucleic acid molecules of the disclosure are known in the art, particularly once the nucleic acid sequence is known. A nucleic acid molecule can encode one protein or more than one protein.

Proteins forming the nanoparticles of this disclosure may be expressed by nucleic acid constructs of this disclosure. As used herein, a nucleic acid construct is a recombinant expression vector, i.e., a vector linked to a nucleic acid molecule encoding a protein such that the nucleic acid molecule can affect expression of the protein when the nucleic acid construct is administered to, for example, a subject or an organ, tissue, or cell. A nucleic acid construct can comprise one nucleic acid molecule or more than one nucleic acid molecule. The vector also enables transport of the nucleic acid molecule to a cell within an environment, such as an organism, tissue, or cell culture. A nucleic acid construct of the present disclosure is produced by human intervention. The nucleic acid construct can be DNA, RNA, or variants thereof. The vector may be a DNA plasmid, a viral vector, or other vector. A vector may be a cytomegalovirus (CMV), retrovirus, adenovirus, adeno-associated virus, herpes virus, vaccinia virus, poliovirus, sindbis virus, or any other DNA or RNA virus vector. A vector may be a pseudotyped lentiviral or retroviral vector. A vector may be a DNA plasmid. A vector may be a DNA plasmid comprising viral components and plasmid components to enable nucleic acid molecule delivery and expression. Methods for the construction of nucleic acid constructs of the present disclosure are well known. See, for example, *Molecular Cloning: a Laboratory Manual*, 3$^{rd}$ edition, Sambrook et al. 2001 Cold Spring Harbor Laboratory Press, and *Current Protocols in Molecular Biology*, Ausubel et al. eds., John Wiley & Sons, 1994. The vector may be a DNA plasmid, such as a CMV/R plasmid such as CMV/R or CMV/R 8 KB (also referred to herein as CMV/R 8 kb). CMV/R is also described in U.S. Pat. No. 7,094,598.

In one aspect is a nucleic acid molecule encoding a fusion protein of any embodiment disclosed herein. In one embodiment, the nucleic acid molecule encodes a fusion protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:245, SEQ ID NO:247, SEQ ID NO:249, SEQ ID NO:251, SEQ ID NO:253, SEQ ID NO:255, and SEQ ID NO:257, joined to an immunogenic portion of an influenza HA protein.

Another embodiment of this disclosure is a nucleic acid molecule encoding a fusion protein comprising, or consisting of, an amino acid sequence at least 80%, 85%, 90%, 91%, 95%, 96%, 97%, 98%, or 99% identical, or 100% identical to SEQ ID NO:89, joined to an immunogenic portion of an influenza HA protein.

In the proteins encoded by these nucleic acid molecules, the immunogenic portion can be an immunogenic portion from an HA protein from any influenza virus, as detailed herein. Thus, in one embodiment, the immunogenic portion comprises or consists of at least 6, 8, 10, 25, 50, 75, 100, 200, 300, or 400 contiguous amino acid residues from an HA protein comprising an amino acid sequence at least 80%, 85%, 90%, 91%, 95%, 96%, 97%, 98%, or 99% identical, or 100% identical to the sequence of an HA protein from an influenza virus selected from the group consisting of A/New Caledonia/20/1999 (1999 NC, H1), A/California/04/2009 (2009 CA, H1), A/Hong Kong/1/1968 (1968 HK, H3), A/Michigan/45/2015 (H1N1), A/Hong Kong/4801/2014 (H3N2), A/Hong Kong/33982/2009 (H9N2), A/Singapore/1/1957 (H2N2), A/Singapore/INFIMH-16-0019/2016, A/Indonesia/5/2005 (H5N1), A/Taiwan/2/2013 (H6N1), A/Anhui/1/2013 (H7N9), A/Jiangxi-Donghu/346/2013 (H10N8), A/Michigan/45/2015 (H1N1), A/USSR/90/1977 (H1N1), A/Brevig Mission/1/1918 (H1N1), A/Brisbane/10/2007 (2007 Bris, H3), A/Perth/16/2009 (2009 Per, H3), A/Brisbane/59/2007 (2007 Bris, H1), B/Brisbane/60/2008, B/Phuket/3073/2013, B/Colorado/06/2017, and B/Florida/4/2006 (2006 Flo, B).

One embodiment of this disclosure is a nucleic acid molecule encoding a protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:259, SEQ ID NO:261, SEQ ID NO:263, SEQ ID NO:265.

Another embodiment of this disclosure is a nucleic acid molecule encoding a protein or fusion protein comprising, or consisting of, an amino acid sequence at least 80%, 85%, 90%, 91%, 95%, 96%, 97%, 98%, or 99% identical, or 100% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, SEQ ID NO: 115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, and SEQ ID NOS:340-346.

A further embodiment of this disclosure is a nucleic acid molecule comprising, or consisting of, an amino acid sequence at least 80%, 85%, 90%, 91%, 95%, 96%, 97%, 98%, or 99% identical, or 100% identical to a sequence selected from the group consisting of SEQ ID NO:258, SEQ ID NO:260, SEQ ID NO:262, and SEQ ID NO:264.

One embodiment of this disclosure is a nucleic acid molecule comprising, or consisting of, an amino acid sequence at least 80%, 85%, 90%, 91%, 95%, 96%, 97%, 98%, or 99% identical, or 100% identical to a sequence selected from the group consisting of SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO: 114, SEQ ID NO: 116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, and SEQ ID NO:224.

One aspect of this disclosure is a recombinant cell comprising a nucleic acid molecule of this disclosure. One aspect of this disclosure is a recombinant virus comprising a nucleic acid molecule of this disclosure.

Nanoparticles of this disclosure can be used to elicit an immune response to influenza virus. One type of immune response is a B-cell response, which results in the production of antibodies against the antigen that elicited the immune response. While all antibodies are capable of binding to the antigen which elicited the immune response that resulted in antibody production, preferred antibodies are those that provide broad heterosubtypic protection against influenza virus. Thus, a nanoparticle of this disclosure elicits antibodies that bind to an influenza HA protein from a virus selected from the group consisting of influenza A viruses, influenza B viruses, and influenza C viruses. These nanoparticles may elicit antibodies that bind to an influenza HA protein from an influenza virus selected from the group consisting of H1, H2, H3, H4, H5, H6, H7, H8, H9, H10, H11, H12, H13, H14, H15, H16, H17, and H18 influenza virus. These nanoparticles may elicit antibodies that bind to the head and/or stem region of an influenza HA protein from a strain of influenza virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B), and antigenic variants thereof.

In one embodiment, a nanoparticle of this disclosure elicits antibodies that bind to an influenza protein comprising an amino acid sequence at least 80%, 85%, 90%, 91%, 95%, 96%, 97%, 98%, or 99% identical, or 100% identical to an amino acid sequence selected from the group consisting of SEQ ID NOs:8, 11, 14, and 17.

Protective antibodies elicited by nanoparticles of this disclosure can protect against viral infections by affecting any step in the life cycle of the virus. For example, protective antibodies may prevent an influenza virus from attaching to a cell, entering a cell, releasing viral ribonucleoproteins into the cytoplasm, forming new viral particles in the infected cell, and/or budding new viral particles from the infected host cell membrane. Antibodies elicited by nanoparticles of this disclosure preferably prevent influenza virus from attaching to or entering the host cell, prevent fusion of viral membranes with endosomal membranes, or prevent release of newly formed virus from the infected host cell.

Because the amino acid sequence of the stem region of influenza virus is highly conserved, protective antibodies elicited by nanoparticles of this disclosure that bind to the stem region may be broadly protective, i.e., protective antibodies elicited by nanoparticles of this disclosure may protect against influenza viruses of more than one Type, Group, subtype, and/or strain. Thus, one embodiment of this disclosure is a nanoparticle that elicits broadly protective antibodies that bind the head and/or stem region of influenza HA proteins. These nanoparticles may elicit the production of antibodies that bind more than one protein comprising an amino acid sequence at least 80%, 85%, 90%, 91%, 95%, 96%, 97%, 98%, or 99% identical, or 100% identical to an amino acid sequence selected from the group consisting of SEQ ID NOs:1, 4, 7, 10, 13, 16, 19, 22, 25, 28, 31, 34, and 37.

One aspect of this disclosure is a vaccine composition (vaccine) comprising any nanoparticle disclosed herein. Because nanoparticles of this disclosure elicit an immune response to an influenza virus, such compositions are useful as vaccines to protect subjects against infection by influenza virus. Vaccine of this disclosure can also contain other components such as adjuvants, buffers and the like. Exemplary adjuvants include aluminum phosphate, benzylkonium chloride, ubenimex, and QS21; genetic adjuvants such as the IL-2 gene or fragments thereof, the granulocyte macrophage colony-stimulating factor (GM-CSF) gene or fragments thereof, the IL-18 gene or fragments thereof, the chemokine (C—C motif) ligand 21 (CCL21) gene or fragments thereof, the IL-6 gene or fragments thereof, CpG, LPS, TLR agonists, and other immune stimulatory genes; protein adjuvants such IL-2 or fragments thereof, the granulocyte macrophage colony-stimulating factor (GM-CSF) or fragments thereof, IL-18 or fragments thereof, the chemokine (C—C motif) ligand 21 (CCL21) or fragments thereof, IL-6 or fragments thereof, CpG, LPS, TLR agonists and other immune stimulatory cytokines or fragments thereof; lipid adjuvants such as cationic liposomes, N3 (cationic lipid), monophosphoryl lipid A (MPL1); other adjuvants including cholera toxin, enterotoxin, Fms-like tyrosine kinase-3 ligand (Flt-3L), bupivacaine, marcaine, and levamisole.

The vaccines of this disclosure may include immunogenic portions of more than one Type. Group, subtype, or strain of influenza virus. Such vaccine may comprise nanoparticles, each of which comprises immunogenic portions from HA proteins from more than one Type, Group, subtype, or strain of influenza virus. Such a nanoparticle (or vaccine) is referred to as a mosaic vaccine (or nanoparticle). A mosaic nanoparticle (or vaccine) can comprise immunogenic portions from as many influenza HA proteins as necessary to elicit production of an immune response sufficient to protect against a desired breadth of virus Types, Groups, subtypes, or strains. In one embodiment, the vaccine comprises immunogenic portions of HA proteins from at least two different influenza strains (i.e., a bivalent vaccine), or from at least three different influenza strains (i.e., a trivalent vaccine), or from at least four different influenza strains (i.e., a quadrivalent vaccine), or from at least five different influenza strains (i.e., a pentavalent vaccine). In one embodiment, the vaccine comprises immunogenic portions of HA proteins from at least six different influenza strains (hexavalent). An example of such a combination is a nanoparticle that comprises immunogenic portions from an influenza A group 1 HA protein, an influenza A group 2 HA protein, and an influenza B HA protein. In an exemplary vaccine of this disclosure, the nanoparticle comprises immunogenic portions of HA proteins from an influenza H1 virus, an influenza H2 virus, an influenza H3 virus, an influenza B virus. In another exemplary vaccine of this disclosure, the nanoparticle comprises immunogenic portions of HA proteins from an influenza H1 virus, an influenza H3 virus, an influenza B virus of the Victoria lineage, and an influenza virus of the Yamagata lineage.

Vaccines of this disclosure may comprise more than one species of nanoparticle of the disclosure, each species of nanoparticle displaying immunogenic portions of an HA protein from the same Type, sub-type, or strain of influenza virus, wherein different species of nanoparticle display immunogenic portions of an HA protein from a different Type, sub-type of strain of influenza virus. For example, a vaccine may comprise a nanoparticle displaying an immunogenic portion of an HA protein from an H1 influenza virus, a nanoparticle displaying an immunogenic portion of an HA protein from an H3 influenza virus, a nanoparticle displaying an immunogenic portion of an HA protein from a first influenza B virus, and a nanoparticle displaying an immunogenic portion of an HA protein from a second influenza B virus.

This disclosure provides methods of vaccinating a subject against influenza virus, the method comprising administering a nanoparticle, or vaccine, of this disclosure to the subject such that an immune response against influenza virus is produced in the subject. In these methods, the nanoparticle may be a monovalent nanoparticle, or a multivalent nanoparticle, as described above. One embodiment of this disclosure is a method to vaccinate a subject against infection with influenza virus by administering a nanoparticle of this disclosure to a subject to elicit an immune response against an influenza virus in the subject.

The terms "individual," "subject," and "patient" are well-recognized in the art and are used interchangeably in this disclosure to refer to any human or other animal susceptible to influenza infection. Examples include, but are not limited to, humans and other primates, including non-human primates such as chimpanzees and other apes and monkey species; farm animals such as cattle, sheep, pigs, seals, goats and horses; domestic mammals such as dogs and cats; laboratory animals including rodents such as mice, rats and guinea pigs; birds, including domestic, wild and game birds such as chickens, turkeys and other gallinaceous birds, ducks, geese, and the like. The terms individual, subject, and patient by themselves, do not denote a particular age, sex, race, and the like. Thus, individuals of any age, whether male or female, are intended to be covered by the present disclosure and include, but are not limited to the elderly, adults, children, babies, infants, and toddlers. Likewise, the methods of this disclosure can be applied to any race, including, for example, Caucasian (white), African-American (black), Native American, Native Hawaiian. Hispanic, Latino, Asian, and European. An "infected subject" is known to have influenza virus in their body. As used herein, a "vaccinated subject" has been administered a vaccine that is intended to provide a protective effect against an influenza virus.

In the vaccination methods of this disclosure, the subject being vaccinated may have been exposed to influenza virus. As used herein, the terms exposed, exposure, and the like, indicate the subject has come in contact with a person or animal that is known to be infected with an influenza virus. Vaccines of this disclosure may be administered using techniques well known to those in the art. Techniques for formulation and administration may be found, for example, in "Remington's Pharmaceutical Sciences", 18$^{th}$ ed., 1990, Mack Publishing Co., Easton, PA. Vaccines may be administered by means including, but not limited to, traditional syringes, needleless injection devices, or microprojectile bombardment gene guns. Suitable routes of administration include, but are not limited to, parenteral delivery, such as intramuscular, intradermal, subcutaneous, or intramedullary injections, as well as intrathecal, direct intraventricular, intravenous, intraperitoneal, intranasal, or intraocular injection. For injection, the nanoparticles of this disclosure may be formulated in aqueous solutions, preferably in physiologically compatible buffers such as Hanks' solution, Ringer's solution, or physiological saline buffer.

Vaccines or nanoparticles of this disclosure may be used to protect a subject against infection by heterologous influenza virus. That is, a vaccine made using an immunogenic portion of an HA protein from one strain of influenza virus is capable of protecting a subject against infection by different strains of influenza. For example, a vaccine of this disclosure comprising an immunogenic portion of an HA protein from influenza A/New Caledonia/20/1999 (1999 NC, H1), may be administered to protect a subject against infection by an influenza virus including, but not limited to, A/New Caledonia/20/1999 (1999 NC, H1), A/California/04/2009 (2009 CA, H1), A/Singapore/1/1957 (1957 Sing, H2), A/Hong Kong/1/1968 (1968 HK. H3), A/Brisbane/10/2007 (2007 Bris, H3), A/Indonesia/05/2005 (2005 Indo, H5), A/Perth/16/2009 (2009 Per, H3), and/or A/Brisbane/59/2007 (2007 Bris, H1).

Vaccines or nanoparticles of this disclosure may be used to protect a subject against infection by an antigenically divergent influenza virus. Antigenically divergent refers to the tendency of a strain of influenza virus to mutate over time, thereby changing the amino acids that are displayed to the immune system. Such mutation over time is also referred to as antigenic drift. Thus, for example, a vaccine of this disclosure comprising an immunogenic portion of an HA protein from a A/New Caledonia/20/1999 (1999 NC, H1) strain of influenza virus may be capable of protecting a subject against infection by earlier, antigenically divergent strains of influenza, and by evolving (or diverging) influenza strains of the future.

Because nanoparticles of this disclosure display immunogenic portions of HA proteins, they are useful for assays for detecting antibodies against influenza virus (i.e., anti-influenza antibodies). Thus, one embodiment of this disclosure is a method for detecting anti-influenza virus antibodies using nanoparticles of this disclosure. Detection of anti-influenza antibodies can generally be accomplished by contacting at least a portion of a sample being tested for the presence of anti-influenza antibodies with a nanoparticle of this disclosure and detecting the presence or absence of an antibody-nanoparticle complex. The presence of a detectable nanoparticle-antibody complex in the sample indicates that the sample contains anti-influenza antibodies.

In these methods, the sample may be obtained or collected from a subject to be tested for the presence of anti-influenza virus antibodies. The subject may or may not be suspected of having anti-influenza antibodies, or of having been exposed to influenza virus. A sample is any specimen obtained from the subject that can be used to test for the presence of anti-influenza virus antibodies, such as a body fluid that can be used to detect the presence of anti-influenza virus antibodies. Examples of body fluids that may be used to practice these methods include, but are not limited to, blood, plasma, serum, lacrimal fluid, and saliva. Blood, or blood-derived fluids such as plasma, serum, and the like, are particularly suitable body fluids for the sample. Those skilled in the art can readily identify additional samples appropriate for practicing the disclosed methods and such samples can be collected and prepared from subjects using methods known in the art. The sample may be refrigerated or frozen before assay.

Any nanoparticle of this disclosure can be used to practice the disclosed methods, so long as the nanoparticle binds to anti-influenza virus antibodies. Useful nanoparticles, and methods of their production have been described in detail herein.

Because assays of this disclosure may be used to detect anti-influenza virus antibodies in a sample, including a blood sample, such assays can be used to identify subjects having anti-influenza antibodies. Thus, one aspect of this disclosure is a method to identify a subject having anti-influenza virus antibodies, by contacting a sample obtained from a subject being tested for anti-influenza antibodies with a nanoparticle of this disclosure and analyzing the contacted sample for the presence of an antibody-nanoparticle complex. The presence of an antibody-nanoparticle complex in the sample indicates the subject has anti-influenza antibodies.

If no anti-influenza antibodies are detected in the sample, this result indicates the subject does not have anti-influenza virus antibodies. The subject being tested may or may not be suspected of having antibodies to influenza virus prior to the test. The disclosed methods may also be used to determine if a subject has been exposed to one or more specific Type, group, sub-group or strain of influenza virus. To make such determination, a sample is obtained from a subject that has tested negative for antibodies (i.e., lacked antibodies) to one or more specific Type, Group, subtype, or strain of influenza virus sometime in their past (e.g., greater than about 1 year, greater than about 2 years, greater than about 3 years, greater than about 4 years, greater than about 5 years, etc.). The sample is then tested for the presence of anti-influenza virus antibodies to one or more Type, Group, subtype, or strain of influenza virus using a nanoparticle-based assay of this disclosure. If the assay indicates the presence of such antibodies, the subject is then identified as having been exposed to one or more Type, Group, subtype, or strain of influenza virus sometime after the previous test identifying them as negative for anti-influenza antibodies. Thus, one aspect of this disclosure is method to identify a subject that has been exposed to a specific Type, Group, subtype, or strain of influenza virus by contacting at least a portion of a sample from a subject being tested for anti-influenza antibodies with a nanoparticle of this disclosure and analyzing the contacted sample for the presence or level of an antibody-nanoparticle complex. Detecting the presence or level of antibody-nanoparticle complex at this step indicates the presence or level of recent anti-influenza antibodies. The level of recent anti-influenza antibody may be compared with a past anti-influenza antibody level, and an increase in the recent anti-influenza antibody level over the past anti-influenza antibody level indicates the subject has been exposed to influenza virus subsequent to determination of the past anti-influenza antibody level.

Methods of this disclosure are also useful for determining the response of a subject to an influenza vaccine. Thus, one aspect of this disclosure is a method for measuring the response of a subject to an influenza vaccine by administering to the subject a vaccine for influenza virus to the subject, contacting at least a portion of a sample from the subject with a nanoparticle of this disclosure, and analyzing the contacted sample for the presence or level of an antibody/nanoparticle complex, wherein the presence or level of antibody-nanoparticle complex indicates the presence or level of recent anti-influenza antibodies. In these methods, an increase in the level of antibody in the sample over the pre-vaccination level of antibody in the subject indicates the vaccine induced an immune response in the subject.

The influenza vaccine administered to the subject may, but need not, comprise a vaccine of this disclosure, as long as the nanoparticle comprises an HA protein that can bind an anti-influenza antibody induced by the administered vaccine. Methods of administering influenza vaccines are known to those of skill in the art.

In any of these analytical methods, analysis of a sample obtained from the subject to detect the presence or level of the antibody-nanoparticle complex may be performed using any known assay formats. In one embodiment, analysis of the sample is performed using an assay format selected from the group consisting of a radial diffusion assay, an enzyme-linked immunoassay, a competitive enzyme-linked immunoassay, a radioimmunoassay, a fluorescence immunoassay, a chemiluminescent assay, a lateral flow assay, a flow-through assay, a particulate-based assay (e.g., using particulates such as magnetic particles or plastic polymers, such as latex or polystyrene beads), an immunoprecipitation assay, a BioCoreJ assay (e.g., using colloidal gold), an immunodot assay (e.g., CMG=s Immunodot System. Fribourg, Switzerland), and an immunoblot assay (e.g., a western blot), an phosphorescence assay, a flow-through assay, a chromatography assay, a PAGE-based assay, a surface plasmon resonance assay, bio-layer interferometry assay, a spectrophotometric assay, and an electronic sensory assay.

In one embodiment, the method includes a step of determining the level of anti-influenza antibody present in the subject prior to administering the vaccine. However, it is also possible to determine the level of anti-influenza antibody present in the subject from prior medical records, if such information is available.

This disclosure also includes kits for producing and/or using nanoparticles of this disclosure. Such kits may include, for example, proteins of this disclosure, nucleic acid molecules of this disclosure that encode proteins of this disclosure, and/or nanoparticles and vaccines suitable for detecting anti-influenza antibodies or vaccinating a subject. Suitable means of detection include the techniques disclosed herein, utilizing nanoparticles of this disclosure. Kits may also comprise a detectable marker, such as an antibody that selectively binds to the nanoparticle, or other indicator molecules. These kits may also contain associated components, such as instructions for using the components in the kit, buffers, labels, containers, tubing, vials, syringes and the like.

In another aspect, the disclosure provides polypeptide comprising an amino acid sequence that is at least 80%, 85%, 90%, 91%, 95%, 96%, 97%, 98%, 99%, or 100% identical to the full length of the amino acid sequence of selected from the group consisting of SEQ ID NOS: 43, 45, 47, 49, 51, 53, 55, 57, 59, 61, 63, 65, 67, 69, 71, 73, 75, 77, 79, 81, 83, 85, and 87, wherein the polypeptide is not identical to the full length of the amino acid sequence of SEQ ID NO:41. The non-naturally occurring polypeptides of this aspect of the disclosure can be used, for example, to prepare nanoparticles, including but not limited to nanoparticles that display HA antigens as described herein. The polypeptides of this aspect are much better expressed in mammalian cells than the related first protein of SEQ ID NO:41 described herein. Each of these polypeptides can be used, for example, to form nanostructures with second proteins as described herein.

Table 3 identifies the residue numbers in each polypeptide that were identified as present at the interface of resulting assembled nanostructures (i.e.: "identified interface residues"). As can be seen, the number of interface residues for the exemplary polypeptides of SEQ ID NO: 43, 45, 47, 49, 51, 53, 55, 57, 59, 61, 63, 65, 67, 69, 71, 73, 75, 77, 79, 81, 83, 85, and 87 range from 4-13. In various embodiments, the isolated polypeptides of the invention comprise an amino acid sequence that is at least 80%, 85%, 90%, 91%, 92%, 93%, 94%, 95%, 96%, 97%, 98%, 99%, or 100% identical, and identical at least at 1, 2, 3, 4, 5, 6, 7, 8, 9, 10, 11, 12, or 13 identified interface positions (depending on the number of interface residues for a given polypeptide), to the full length of the amino acid sequence of a polypeptide selected from the group consisting of SEQ ID NOS: 43, 45, 47, 49, 51, 53, 55, 57, 59, 61, 63, 65, 67, 69, 71, 73, 75, 77, 79, 81, 83, 85, and 87. In other embodiments, the isolated polypeptides of the invention comprise an amino acid sequence that is at least 80%, 85%, 90%, 91%, 92%, 93%, 94%, 95%, 96%, 97%, 98%, 99%, or 100% identical over its length, and identical at least at 20%, 25%, 33%, 40%, 50%, 60%, 70%, 75%, 80%, 90%, or 100% of the identified interface positions, to the amino acid sequence of a polypeptide selected from the group consisting of 43, 45, 47, 49, 51, 53, 55, 57, 59, 61, 63, 65, 67, 69, 71, 73, 75, 77, 79, 81, 83, 85, and 87. In other embodiments, variability relative to the reference sequences may comprise surface residues as noted in Table 4, and/or conservative amino acid substitutions as described herein.

Each of these polypeptides can be used, for example, to form nanoparticles with second proteins as described herein. Thus, in another embodiment, the disclosure provides nanoparticles, comprising:

(a) a plurality of first assemblies, each first assembly comprising a plurality of identical first polypeptides comprising an amino acid sequence that is at least 80%, 85%, 90%, 91%, 95%, 96%, 97%, 98%, 99%/o, or 100% identical to the full length of the amino acid sequence of a polypeptide selected from the group consisting of SEQ ID NOS: 43, 45, 47, 49, 51, 53, 55, 57, 59, 61, 63, 65, 67, 69, 71, 73, 75, 77, 79, 81, 83, 85, and 87, wherein the polypeptide is not identical to the full length of the amino acid sequence of SEQ ID NO:41; and, (b) a plurality of second assemblies, each second assembly comprising a plurality of second polypeptides;

wherein the sequence of the first polypeptide differs from the sequence of the second polypeptide; and wherein the plurality of first assemblies non-covalently interact with the plurality of second assemblies to form the nanoparticle.

The nanoparticles of this aspect of the disclosure can be used for any suitable purpose, including but not limited to delivery vehicles, as the nanoparticles can encapsulate molecules of interest and/or the first and/or second polypeptides can be modified to bind to molecules of interest (diagnostics, therapeutics, detectable molecules for imaging and other applications, etc.). The nanoparticles of this aspect are well suited for a variety of applications, including vaccine design, targeted delivery of therapeutics, and bioenergy. In one embodiment, one or both of the first assemblies and the second assemblies comprise at least one first polypeptide and/or at least one second polypeptide joined to an immunogenic portion of an antigen, thereby forming a fusion protein; wherein the nanoparticle displays the immunogenic portion of the antigen on its surface. Any suitable polypeptide antigen can be used, including, but not limited to the pathogen-specific antigens such as antigens from hepatitis (A, B, C, E, etc.) virus, human papillomavirus, herpes simplex viruses, cytomegalovirus, Epstein-Barr virus, influenza virus, parainfluenza virus, coronavirus, rhinovirus, enterovirus, measles virus, mumps virus, polio virus, rabies virus, human immunodeficiency virus, respiratory syncytial virus, Rotavirus, rubella virus, varicella zoster virus, Ebola virus, cytomegalovirus, Marburg virus, norovirus, vanola virus, any Flavivus including but not limited to West Nile virus, yellow fever virus, dengue virus, tick-borne encephalitis virus, zika virus, and Japanese encephalitis virus, *Bacillus anthracis, Bordetalla pertusis, Chlamydia trachomatis, Clostridium tetani, Clostridium difficile, Corynebacterium diptheriae, Coxiella burnetii, Escherichia coli, Haemophilus influenza, Helicobacter pylori, Leishmania donovani, L. tropica* and *L. braziliensis, Mycobacterium tuberculosis, Mycobacterium leprae, Neisseria meningitis, Plasmodium falciparum, P. ovale, P. malariae* and *P. vivax, Pseudomonas aeruginosa, Salmonella typhi, Schistosoma hematobium, S. mansoni, Streptococcus pneumoniae* (group A and B). *Staphylococcus aureus, Toxoplasma gondii, Trypanosoma brucei, T. cruzi* and *Vibrio cholerae*; antigens expressed in or on the surface of tumors/tumor cells (including but not limited to p53 (colorectal cancer), alphafetoprotein (germ cell tumors; hepatocellular carcinoma), carcinoembryonic antigen (bowel cancers), CA-125 (ovarian cancer), human epidermal growth factor receptor-2 (HER-2, breast cancer), MUC-1 (breast cancer), NY-ESO-1 (esophageal cancer, non-small-cell lung cancer), epithelial tumor antigen (breast cancer), tyrosinase (malignant melanoma), Disialoganglioside (GD2, neuroblastoma), melanoma-associated antigen gene-1 (MAGE-1 (malignant melanoma)), and beta amyloid (for Alzheimer's and other amyloid-based diseases), etc.

In various embodiments of the nanoparticles of this aspect of the disclosure, the plurality of second polypeptides are at least 80%, 85%, 90%, 91%, 95%, 96%, 97%, 98%, 99%, or 100% identical to the full length of the amino acid sequence of SEQ ID NO:89 (I53-dn5B). The percent identities or the second proteins does not include any additional domains that might be added in generating a fusion protein (such as second proteins fused to an antigen, as described below and herein)

All embodiments and discussion above for the HA-antigen presenting NPs are equally applicable to the nanoparticles of this aspect of the disclosure. Thus, in one embodiment, the first polypeptides and second polypeptides may be between 30 and 250 amino acids in length, between 30 and 225 amino acids in length, between 30-200 amino acids in length, between 30-175 amino acids in length, between 50-250 amino acids in length, between 50-225 amino acids in length, between 50-200 amino acids in length, between 50-175 amino acids in length, between 75-250 amino acids in length, between 75-225 amino acids in length, between 75-200 amino acids in length, between 75-175 amino acids in length, between 100-250 amino acids in length, between 100-225 amino acids in length, between 100-200 amino acids in length, between 100-175 amino acids in length, between 125-250 amino acids in length, between 125-225 amino acids in length, between 125-200 amino acids in length, between 125-175 amino acids in length, between 150-250 amino acids in length, between 150-225, amino acids in length, between 150-200 amino acids in length, and between 150-175 amino acids in length. Similarly, nanoparticles of this aspect can have any shape and/or symmetry suitable for an intended use, including, but not limited to, tetrahedral, octahedral, icosahedral, dodecahedral, and truncated forms thereof. Nanoparticles of this aspect can be of any suitable size for an intended use, including but not limited to about 10 nm to about 100 nm in diameter.

In other aspects, the disclosure provides nucleic acids encoding a polypeptide of the disclosure, expression vectors comprising these nucleic acid molecules, and cells comprising the nucleic acid molecules and/or expression vectors. All embodiments of nucleic acids, expression vectors, and cells as described above are equally application for this aspect of the disclosure.

Certain features of this disclosure, which are, for clarity, described in the context of separate aspect of this disclosure, may also be provided in combination in a single aspect or embodiment. Conversely, various features of this disclosure, which are, for brevity, described in the context of a single aspect, may also be provided separately or in any suitable sub-combination. All combinations of the aspect and embodiments of this disclosure are specifically embraced by this disclosure and are disclosed herein just as if each and every combination was individually and explicitly disclosed. In addition, all sub-combinations are also specifically embraced by this disclosure and are disclosed herein just as if each and every such sub-combination was individually and explicitly disclosed herein.

The publications discussed herein are provided solely for their disclosure prior to the filing date of the present application. Nothing herein is to be construed as an admission that this disclosure is not entitled to antedate such publication by virtue of prior invention. Further, the dates of publication provided may be different from the actual publication dates, which may need to be independently confirmed. All publications mentioned herein are incorporated herein by reference to disclose and describe the methods and/or materials in connection with which the publications are cited.

EXAMPLES

Example 1

In Vitro Assembly of Nanoparticles

A. Expression and Screening of Trimeric Building Blocks Comprising an HA Protein and a Trimeric Assembly Domain Human codon-optimized sequences for trimeric building blocks including HA fusions were synthesized by Genscript or cloned from existing DNA using Gibson assembly. All genes were cloned into the mammalian expression vector pVRC 8400 under CMV L/E promoter with HTLV-1 R region for efficient transcription using the XbaI and AvrII restriction sites. Recombinant proteins were expressed by transient transfection of Expi293F™ cells with Expifectamine™ (ThermoFisher Scientific) according to the manufacturer's instructions. Cells were harvested four days post transfection by centrifugation and supernatants were filtered at 0.22 µm. Optimal constructs were first selected by SDS-PAGE for expression and biolayer interferometry for antigenicity. Trimer formation was assessed by size-exclusion chromatography, followed by differential scanning fluorimetry to assess thermostability.

B. Expression and Screening of Pentameric Building Blocks

All genes for expression in bacteria were synthesized and cloned into expression plasmids by Genscript, Integrated DNA Technologies, or from existing DNA using Gibson assembly. All genes were cloned into the pET29b(+) vector between the NdeI and XhoI restriction sites. Recombinant proteins were expressed in T7 Express Competent E. coli (New England Biolabs) by IPTG induction and overnight expression at 18° C. After cell lysis, soluble protein expression was assayed by SDS-PAGE of the cleared lysate.

All genes for expression from human cell lines were cloned into the pCMV vector from existing DNA with an N-terminally appended IgK signal peptide, with the modified gene inserted between the NcoI and XhoI restriction sites. Recombinant proteins were expressed by transient transfection of Expi293F™ cells using polyethylenimene (PEI). Protein expression was assessed by Western blots against genetically fused hexahistidine tags using Anti-His HRP-conjugated antibody (R&D Systems).

C. Expression and Purification of Trimeric Building Blocks Comprising an HA Protein and a Trimeric Assembly Domain Recombinant proteins were expressed by transient transfection of Expi293F™ cells (ThermoFisher Scientific) using the manufacturer's protocol. Cells were harvested four days post transfection by centrifugation and supernatants were filtered at 0.45 µm. NaCl and Tris-HCl pH 8.0 were added to 350 mM and 50 mM, respectively, and the supernatant was incubated overnight with Ni Sepharose™ Excel resin (GE Healthcare). Resin was washed twice with buffer containing 30 mM imidazole before being eluted five times with 300 mM imidazole. Eluted protein was loaded over a Superdex™ 200 increase 10/300 or a HiLoad Superdex™ 200 µg column (GE Healthcare) in phosphate buffered saline (PBS), pH 7.4 (ThermoFisher Scientific) to further purify the protein by size exclusion chromatography. The purified protein was quantified by UV/vis absorption spectroscopy and snap frozen in liquid nitrogen and stored at −80° C.

D. Expression and Purification of Pentameric Building Blocks

Recombinant proteins were expressed in T7 Express Competent *E. coli* by IPTG induction and overnight expression at 18° C. After cell lysis, the lysate was separated by centrifugation and filtered at 0.22 μm before being applied to a HisTrap HP column (GE Healthcare) and washed with 0.75% CHAPS prior to elution to remove endotoxin. A gradient of 0-150 mM imidazole was used to further remove contaminants before eluting with 500 mM imidazole. Eluted protein was applied to a Superdex™ 200 Increase 10/300 or HiLoad Superdex™ 75 μg in 25 mM Tris-HCl pH 8.0, 150 mM NaCl, 5% glycerol to further purify the target protein by size exclusion chromatography. The purified protein was quantified by UV/vis absorption spectroscopy and tested to ensure low endotoxin using a Charles River Endosafe™ PTS, then snap frozen in liquid nitrogen and stored at −80° C.

E. In Vitro Assembly of HA-Bearing Nanoparticles

Generally, 100% valency particles (20 identical HA trimers per icosahedral nanoparticle) were prepared by mixing HA-bearing trimeric proteins and pentamer building blocks at equimolar concentrations (depicted schematically in FIG. 1A).

For assembly of "A/Michigan/45/2015 (H1N1) HA 1-676 Y98F no_lkr_dn5B.SA" (abbreviated as "H1-dn5 B") with "I53-dn5 A" with 100% HA trimer valency, the two proteins were mixed to a final concentration of 25.0 μM each with a background salt concentration of 150 mM NaCl. The solution was mixed vigorously by pipette and allowed to sit at room temp for 30 minutes. The assembled nanoparticle sample was purified on a Superose™ 6 Increase 10/300 column (GE Healthcare) in buffers comprising 25 mM Tris-HCl pH 8.0, 150 mM NaCl, 5% glycerol. This protocol was identical for assembly of "A/Hong_Kong/4801/2014 (H3N2) HA 1-676 Y98F GG lkr dn5B.SA" (abbreviated as "H3-dn5 B") with "I53-dn5 A" with 100% trimer valency, with the exception of the mixing concentration being 22.0 μM. This protocol was also used to assemble additional nanoparticles with 100% HA trimer by mixing "I53-dn5 A" in equimolar amounts with either "A/Anhui/1/2013 (H7N9) HA 1-676 Y98F no lkr dn5B.SA" (abbreviated as "H7-dn5 B"), "A/Singapore/1/1957 (H2N2) SS rpk22 676 no_lkr_dn5B.SA" (abbreviated as "ssH2-dn5 B"), "A/Indonesia/5/2005 (H5N1) delF SS rpk22 676 no_lkr_dn5B.SA" (abbreviated as "ssH5-dn5 B"), "A/Anhui/1/2013 (H7N9) SS no256 676 no lkr dn5B.SA" (abbreviated as "ssH7-dn5 B"), or "A/Jiangxi-Donghu/346/2013 (H10N8) SS no256 676 no lkr dn5B.SA" (abbreviated as "ssH10-dn5 B") individually at final concentrations ranging from 23.1-38.9 μM for each protein.

For assembly of "B/Brisbane/60/2008 HA 1-674 no lkr dn5B.SA" (abbreviated as "Bvic-dn5 B") with "I53-dn5 A", the two proteins were mixed to a final concentration of 18.7 μM each with a background salt concentration of 1 M NaCl. To achieve this, "Bvic-dn5 B" was first mixed with 25 mM Tris-HCl pH 8.0, 1.85 M NaCl and 5% glycerol prior to addition of "I53-dn5 A", such that the final salt concentration would be 1 M NaCl. The solution was mixed vigorously by pipette and allowed to sit at room temp for 30 minutes. The assembled nanoparticle sample was purified on a Superose™ 6 Increase 10/300 column (GE Healthcare) in buffers comprising 25 mM Tris-HCl pH 8.0, 1 M NaCl, 5% glycerol. This protocol was also used to assemble 100% HA trimer nanoparticles by mixing "I53-dn5 A" in equimolar amounts with either "A/Indonesia/5/2005 (H5N1) 1-676 delF Y98F no lkr dn5B.SA" (abbreviated as "H5-dn5 B"), "A/Taiwan/2/2013 (H6N1) HA 1-676 Y98F no lkr dn5B.SA" (abbreviated as "H6-dn5 B") or "A/Jiangxi-Donghu/346/2013 (H10N8) HA 1-676 Y98F no lkr dn5B.SA" (abbreviated as "H10-dn5 B") individually at final concentrations ranging from 16.7-22.0 μM for each protein.

For assembly of "B/Phuket/3073/2013 HA 1-674 no lkr dn5B.SA" (abbreviated as "Byam-dn5 B") with "I53-dn5 A", the two proteins were mixed to a final concentration of 13.0 μM. To achieve this, "Byam-dn5 B" was first mixed with 25 mM Tris-HCl pH 8.0, 3.85 M NaCl and 5% glycerol prior to addition of "I53-dn5 A", such that the final salt concentration would be 2 M NaCl. The solution was mixed vigorously by pipette and allowed to sit at room temp for 30 minutes. The assembled nanoparticle sample was purified on a Superose™ 6 Increase 10/300 column (GE Healthcare) in buffers comprising 25 mM Tris-HCl pH 8.0, 2 M NaCl, 5% glycerol.

For co-assembly of "H1-dn5 B", "H3-dn5 B". "Bvic-dn5 B" and "Byam-dn5 B" with "I53-dn5 A", the HA trimers were first mixed at equimolar concentrations in a concentrated salt solution, prior to mixing with "I53-dn5 A" such that the final concentration of NaCl during assembly was 1 M. This was performed with the addition of 25 mM Tris-HCl pH 8.0, 1.85 M NaCl, 5% glycerol to bring all four HA trimers to an initial concentration of 5.25 μM each, or 21.0 μM in total between all four proteins. "I53-dn5 A" was then added to be equimolar with the sum of the molar concentration of HA trimers, with final concentrations of 15.75 μM for "I53-dn5 A" and 3.94 μM each for "H1-dn5 B", "H3-dn5 B", "Bvic-dn5 B" and "Byam-dn5 B". The solution was mixed vigorously by pipette and allowed to sit at room temp for 30 minutes. The assembled nanoparticle sample was purified on a Superose™ 6 Increase 10/300 column (GE Healthcare) in buffers comprising 25 mM Tris-HCl pH 8.0, 1 M NaCl, 5% glycerol. This protocol has been similarly used to co-assemble various combinations of HA trimers in varying numbers and identities, including part or all of "H1-dn5 B", H3-dn5 B", "H5-dn5 B", "H6-dn5 B", "H7-dn5 B", H10-dn5 B", "Bvic-dn5 B" and "Byam-dn5 B". For each case, the protocol has been modified to mix the HA trimers at varying equimolar amounts, prior to mixing with "I53-dn5 A" at an amount that is equimolar to the sum of the total HA trimer molar concentrations, ending at a final concentration ranging from 15.9-26.4 μM each for "I53-dn5 A" and the sum of all molar concentrations of included HA trimers. This protocol has further been generalized to various combinations of "ssH2-dn5 B", "ssH5-dn5b", "ssH7-dn5b" and/or "ssH10-dn5 B" using the same principles, only while maintaining the background NaCl concentration at 150 mM by not adding additional concentrated salt solutions.

For all assemblies, sample load and peak fractions were analyzed by SDS-PAGE in the presence and absence of reducing agents to confirm identities of proteins in each peak. Peak fractions for HA-bearing nanoparticles were pooled and filtered at 0.22 μm to remove aggregates or contaminants. The final materials were quantified by UV/vis absorption spectroscopy, snap frozen in liquid nitrogen and stored at −80° C.

An example of the expression, purification, assembly, and quality control monitoring conducted in the production of nanoparticles of this disclosure is shown in FIGS. 1B-1 to 1B-4 for "H1-dn5 B" displayed individually on I53-dn5 nanoparticles. Size-exclusion chromatography (SEC) was used to purify assembled nanoparticles from un-assembled protein components (FIG. 1B-1). An SDS-PAGE of the SEC elution peaks was used to confirm the protein identities by confirming the presence of the "H1-dn5 B" and "I53-dn5 A" protein constructs (FIG. 1B-2). UV/Vis spectroscopy was used to quantify protein and confirm minimal protein aggregation from the freeze-thaw process by comparing the spectrum before and after snap freezing and thawing (FIG. 1B-3). Negative-stain transmission electron microscopy was used to confirm the integrity of the nanoparticle after the freeze-thaw process (FIG. 1B-4).

Another example of the expression, purification, assembly, and quality control monitoring conducted during production of nanoparticles of this disclosure is shown in FIGS. 1C-1 to 1C-4 for the "H1-dn5 B", "H3-dn5 B", "Bvic-dn5 B" and "Byam-dn5 B" HA protein constructs co-assembled on I53-dn5 nanoparticles. Size-exclusion chromatography (SEC) was used to purify assembled nanoparticles from un-assembled protein components (FIG. 1C-1). An SDS-PAGE of SEC the elution peaks was used to confirm the protein identities by confirming the presence of "H1-dn5 B", "H3-dn5 B", "Bvic-dn5 B", "Byam-dn5 B" and "I53-dn5 A" (FIG. 1C-2). UV/Vis spectroscopy was used to quantify the proteins and confirm minimal protein aggregation from the freeze-thaw process by comparing the spectrum before and after snap freezing and thawing (FIG. 1C-3). Negative-stain transmission electron microscopy was used to confirm the integrity of the nanoparticle after the freeze-thaw process (FIG. 1C-4).

F. Thermostability Measurement

Thermal unfolding of purified proteins was measured by nano differential scanning fluorometry (nanoDSF) using a Prometheus NT.48 instrument (NanoTemper Technologies). HA-trimeric building block fusions and assembled materials were diluted to approx. 0.5 mg/mL in PBS and subjected to nanoDSF measurement with a temperature increment set to 1° C./min from 30-95° C. Thermal transition midpoint temperature ($T_m$) was obtained from thermal unfolding curves plotted as slope ($\Delta$(F350 nm/F330 nm)/$\Delta$T) against temperature (° C.) generated from fluorescent measurements at 350 and 330 nm. The nanoDSF results are shown in the following table:

| | nanoDSF | | |
|---|---|---|---|
| | Onset #1 for Ratio (° C.) | Inflection Point #1 for Ratio (° C.) | Inflection Point #2 for Ratio (°C) |
| HA-1 | 54.92 | 58.20 | |
| HA-2 | 54.94 | 58.15 | |
| HA-3 | 55.12 | 58.13 | |
| HA-4 | 56.65 | 59.87 | |
| HA-5 | 54.20 | 58.14 | |
| HA-6 | 55.15 | 58.61 | |
| HA-dn5-1 | 55.35 | 59.83 | 80.30 |
| HA-dn5-2 | 55.53 | 59.46 | 80.00 |
| HA-dn5-3 | 55.46 | 59.32 | 79.70 |
| HA-dn5-4 | 55.56 | 63.66 | 80.16 |
| HA-dn5-5 | 55.36 | 59.81 | 80.72 |
| HA-dn5-6 | 55.97 | 60.65 | 80.68 |

G. UV/Vis Spectroscopy

Quantification of protein amounts was either performed on a NanoDrop™ 2000 UV/vis spectrometer, a NanoDrop™ 8000 UV/vis spectrometer (ThermoFisher Scientific) or a Cary 8454 UV/vis (Agilent Technologies). Extinction coefficients and molecular weights of protein samples were calculated based on amino acid sequences using the Expasy Protparam™ web server, and protein concentrations were calculated using Beer's law.

H. Electron Microscopy of HA-Bearing Nanoparticles

Samples were prepared for negative stain EM by diluting to 0.05-0.075 mg/mL using a Tris-based buffer, and 6.0 μL was incubated on a glow-discharged, copper, carbon-coated grid for 1 min before quickly immersing the grid in a 40 μL drop of water. The water was blotted off within seconds by Whatman No. 1 filter paper, and the grid was immediately dipped into a 6.0 μL drop of stain (2% w/v uranyl formate). The stain was immediately blotted away and within seconds the grid was dipped into another 6.0 μL drop of stain, which was left on the grid for 30 seconds. At the end of this time, the stain was blotted dry and allowed to air dry for 5 minutes prior to imaging. Images were recorded on a FEI Tecnai Spirit™ transmission electron microscope equipped with a Gatan US4000 CCD camera, using Leginon software for data collection at a nominal magnification of 52,000× at a defocus range comprised between −1 um and −4 um. Particles were picked using DoG™ Picker. Particle images were extracted and analyzed using RELION™ 2.1. 2D class averages were made with RELION™ 2.1, rotationally averaged images were created from RELION™ 2.1 class averages using EMAN2™ image processors.

I. Antigenic Characterization by BioLayer Interferometry (BLI)

Various HA head- and stem-directed monoclonal antibodies were immobilized on the AHC biosensors (fortéBio) through pre-coated anti-human Fc antibody. All biosensors were hydrated in PBS prior to use. Monoclonal antibodies used included: CR6261 (anti-group 1 stem), CR8020 (anti-group 2 stem), MEDI8552 (cross-group anti-stem), CT149 (cross-group anti-stem), F005-126 (anti-H3 head), 5J8 (anti-H1 head), 2D1 (anti-H1 head), and 441D6 (anti-H1 head) for "H1-dn5 B" construct variants; CR6261, CR8020, MEDI8552, CT149, CR9114 (pan-influenza A/B anti-stem), C05 (selective anti-receptor-binding site), and F045-092 (mostly anti-H3 receptor-binding site) for all other constructs. After loading the monoclonal antibody on AHC biosensors (0.030 mg/mL for 5 min), the sensors were briefly dipped in assay buffer (1% BSA-PBS). The biosensors were then dipped in wells containing various HA-dn5 B constructs diluted in assay buffer (0.030 mg/mL) for 5 min. All assay steps were performed at 30° C. with agitation set at 1,000 rpm in the Octet HTX instrument (fortéBio). Data analysis was carried out using Octet analysis software (version 9.0).

Example 2

Preparation of HA-Bearing Nanoparticles for Immunization

As described above, cocktail nanoparticle vaccines contain nanoparticles displaying a single or multiple distinct HA antigens. "Mosaic" nanoparticle vaccines comprise nanoparticles co-displaying multiple distinct HA antigens. Prior to immunization, cocktail and mosaic HA-bearing nanoparticles were prepared in 1:1 ratio of 50 mM Tris-HCl, 2M NaCl buffer and Addavax™ adjuvant at equimolar amounts at final concentrations indicated in the following Table:

| Cages | Cocktail (4HA) (ug/ml) M*/F*/P* | Mosaic (4HA) (ug/ml) M*/F*/P* | Cocktail (8HA) (ug/ml) M*/F* | Mosaic (multiple in one, 8HA) (ng/ml) M*/F* | Mosaic (3 + 3 + 2, 8HA) (ug/ml) M* | Cocktail (Stem, 4HA) (ug/ml) M* | Mosaic (stem, 4HA) (ug/ml) M* |
|---|---|---|---|---|---|---|---|
| H1 | 1.5/5/15 | | 0.75/2.5 | 0.75/2.5 | | | |
| H3 | 1.5/5/15 | | 0.75/2.5 | 0.75/2.5 | | | |
| By | 1.5/5/15 | | 0.75/2.5 | 0.75/2.5 | | | |
| Bv | 1.5/5/15 | | 0.75/2.5 | | | | |
| H5 | | | 0.75/2.5 | | | | |
| H6 | | | 0.75/2.5 | | | | |
| H7 | | | 0.75/2.5 | | | | |
| H10 | | | 0.75/2.5 | | | | |
| H1; H3; By; BV | | 6/20/60 | | | | | |
| H1; H3; By; Bv; H5; H6; H7; H10 | | | | 6/20 | | | |
| H1; H5; H6 + H3; H7; H10 + By; Bv | | | | | 2.25 + 2.25 + 1.5 | | |
| H2 Stem | | | | | | 1.5/5/15 | |
| H5 Stem | | | | | | 1.5/5/15 | |
| H7 Stem | | | | | | 1.5/5/15 | |
| H10 Stem | | | | | | 1.5/5/15 | |
| H2; H5; H7; H10 | | | | | | | 6 |

M* Mice
F* Ferret
P* Primates

Example 3

Animal Immunization and Testing

A. Animal Experiments

Six- to eight-week old female BALB/cJ mice were obtained from Jackson Laboratories and used in immunogenicity studies. Six-month old domestic ferrets were obtained from Triple F Farm and used in immunogenicity studies. Five- to six-year old rhesus macaques were repurposed from other studies and used in immunogenicity studies. Nonhuman primates were randomized based on sex, weight, age, and previous study records prior to the study.

B. Immunization

Mice (N=10) were immunized intramuscularly (IM) with 6 μg of commercial quadrivalent influenza vaccine (QIV 2017), commercial trivalent influenza vaccine (TIV 2011), or various preparations of HA-bearing nanoparticles with or without Addavax™ (Invivogen) adjuvant (50% v/v) three times on weeks 0, 4, and 8, or 24. Immunogens were prepared in 100 μL volumes per mouse and 50 μL was injected IM into each hind leg. Serum samples were collected periodically before and after immunization and used for immunological assays. For the experimental virus challenge studies, mice were inoculated intranasally with a 10-20× $LD_{50}$ of A/Vietnam/1203/04 H5N1 or mouse-adapted A/Philippines/2/82 H3N2 viruses. All the challenge studies were conducted in ABSL-2 or ABSL-3 facility at Bioqual, Inc. Mice were monitored twice daily for development of clinical signs and weighed daily for 14 days after infection. Any animals that had lost 20% or more of their pre-challenge body weight were humanely euthanized.

Ferrets (N=6) were immunized IM with 20 μg of commercial QIV 2017 or HA-bearing nanoparticles with Addavax™ adjuvant (50% v/v) twice at weeks 0 and 4. Immunogens were prepared in 500 μL volumes per ferret and injected IM into limbs. Serum samples were collected periodically before and after immunization and used for immunological assays.

Rhesus macaques (N=4) were immunized IM with 60 μg of QIV 2017 or HA-bearing nanoparticles with Addavax adjuvant (50% v/v) three times at weeks 0 and 8. Immunogens were prepared in 1.0 mL volumes per NHP and injected IM into limbs. Serum samples were collected periodically before and after immunization and used for immunological assays.

C. Enzyme-Linked Immunosorbent Assay (ELISA)

HA-specific immunoglobulin G (IgG) level in immune sera was assessed by ELISA. MaxiSorp™ plates (Nunc) were coated with recombinant HA or stem-only HA proteins (0.1 mL/well, 2 μg/mL) in PBS at 4° C. overnight. Plates were then blocked with PBS containing 5% skim milk at 37° C. for an hour. After washing with PBS with 0.05% Tween 20, 4-fold serial dilution series of immune sera (0.1 mL/well) were added and the plates were incubated at 37° C. for an hour. After another wash, horseradish peroxidase (HRP)-conjugated secondary antibodies were then added and incubated at 37° C. for an hour. The plates were then developed by adding KPL SureBlue™ TMB peroxidase substrate (seracare) and the reactions were stopped by adding 1 M $H_2SO_4$. The plates were read by a SpectraMax™ Paradigm microplate reader (Molecular Devices) with absorbance at 450 nm (and 650 nm for background subtraction). Background-subtracted data were analyzed with Prism™ (GraphPad) and the endpoint titers were calculated from four-parameter nonlinear regression curve fit with the threshold value (average absorbance of blank wells +2 s.d, or 0.1, whichever the highest).

D. Reporter-Based Microneutralization Assay

All viruses were made by reverse genetics technology with 8 plasmids encoding each influenza A virus segment under control of biscistronic polI/polII promoters obtained from St. Jude Children's Research Hospital. For the reporter viruses, the plasmid encoding PB1 segment was modified to express the fluorescent reporter gene (tdKatushka2 or mKate2) and used for virus rescue. All reporter viruses were propagated in engineered MDCK-SIAT1 cells constitutively expressing viral PB1 (MDCK-SIAT1-PB1) in the presence of TPCK-treated trypsin (1 µg/mL, Sigma) and titrated in MDCK-SIAT1-PB1 cells. OptiMEM™-TPCK (OptiMEM™ with 1 µg/mL TPCK-trypsin and penicillin/streptomycin) was used to make four-fold serial dilutions of RDE-treated sera or antibodies and to dilute pre-titrated influenza viruses to a final concentration of 1,000-4,000 fluorescent foci per well. In a 96-well plate, serum or antibody and virus were mixed and incubated 1 h at 37° C. prior to adding to substrate MDCK-PB1 cells. Control wells of virus alone (VC) and diluent alone (CC) were included on each plate. Cells were seeded at $1.0 \times 10^4$ cells per well 24 h prior to the assays and washed once with PBS before use. Fifty microliters of antibody/virus mixture were then added to wells of pre-washed cells in duplicate and the plates were incubated for 18-22 h at 37° C. and 5% $CO_2$ humidified atmosphere. The individual fluorescent cells in each well were counted automatically using Celigo™ image cytometer (Nexcelom Biosciences). The percent neutralization was calculated by constraining the VC control as 0% and the CC control as 100%, and plotted against serum/antibody concentration. A curve fit was generated by a four-parameter nonlinear fit model in Prism (GraphPad). The half-maximal inhibitory concentration ($IC_{50}$) was obtained from the curve fit for each serum sample or antibody, respectively.

E. Pseudotype Virus Neutralization Assays

Lentivirus-based pseudovirus displaying influenza HA and NA were produced. Briefly, pseudovirus was produced by transfection of 293T cells of HA and corresponding NA along with the lentiviral packaging and reporter plasmids. A plasmid encoding human type II transmembrane serine protease TMPRSS2 gene was also cotransfected for efficient proteolytic activation of HA. Forty-eight hours after transfection, supernatants were harvested, filtered, and frozen until use. Immune sera were treated with receptor-destroying enzyme (RDE (II), SEIKEN Accurate Chemical and Scientific) and heat-inactivated before subjecting to the neutralization assays. Serial dilution series of RDE-treated sera or monoclonal antibodies were incubated with pre-titrated HA-NA pseudotyped viruses (A/Vietnam/1203/04 H5N1 and A/Anhui/1/13 H7N9) prior to adding to 96-well plates pre-seeded with 293A cells. After incubating overnight at 37° C., 5% $CO_2$ humidified atmosphere, the culture media was replaced and the plates were incubated another 2 days. Firefly luciferase activity was measured by lysing cells and adding substrate (Promega).

Luminescence was measured by using a SpectraMax™ L (Molecular Devices). Data analysis and $IC_{50}$ calculation was carried out as described above.

F. Statistical Analysis

Multi-group comparisons were carried out by nonparametric Kruskal-Wallis test with Dunn's post-hoc analysis in Prism™ (GraphPad) unless mentioned otherwise. Differences were considered significant when P values were less than 0.05. Statistical methods and P value range can be found in the Brief Description of the Figures.

G. Immunization Testing

To compare the efficacy of immunization with commercially-available HA vaccines, cocktails of nanoparticle constructs of this disclosure, and mosaic nanoparticle constructs of this disclosure, mice were immunized with different doses of these vaccine compositions and titers were evaluated by ELISA and serum microneutralization (MN) titer to viruses. Serum antibody titer to HAs was measured by ELISA at 2 weeks after the third immunization (week 10) with either Addavax™-adjuvanted immunogens at 6 µg (FIG. 2A) or immunogens without adjuvant at 6 µg (FIG. 2B). Both cocktail and mosaic nanoparticles were immunogenic in mice in the presence or absence of Addavax™ adjuvant and elicited comparable or superior HA-binding antibody responses to all four vaccine-matched virus HAs compared to the commercial vaccine.

Figure 2D:
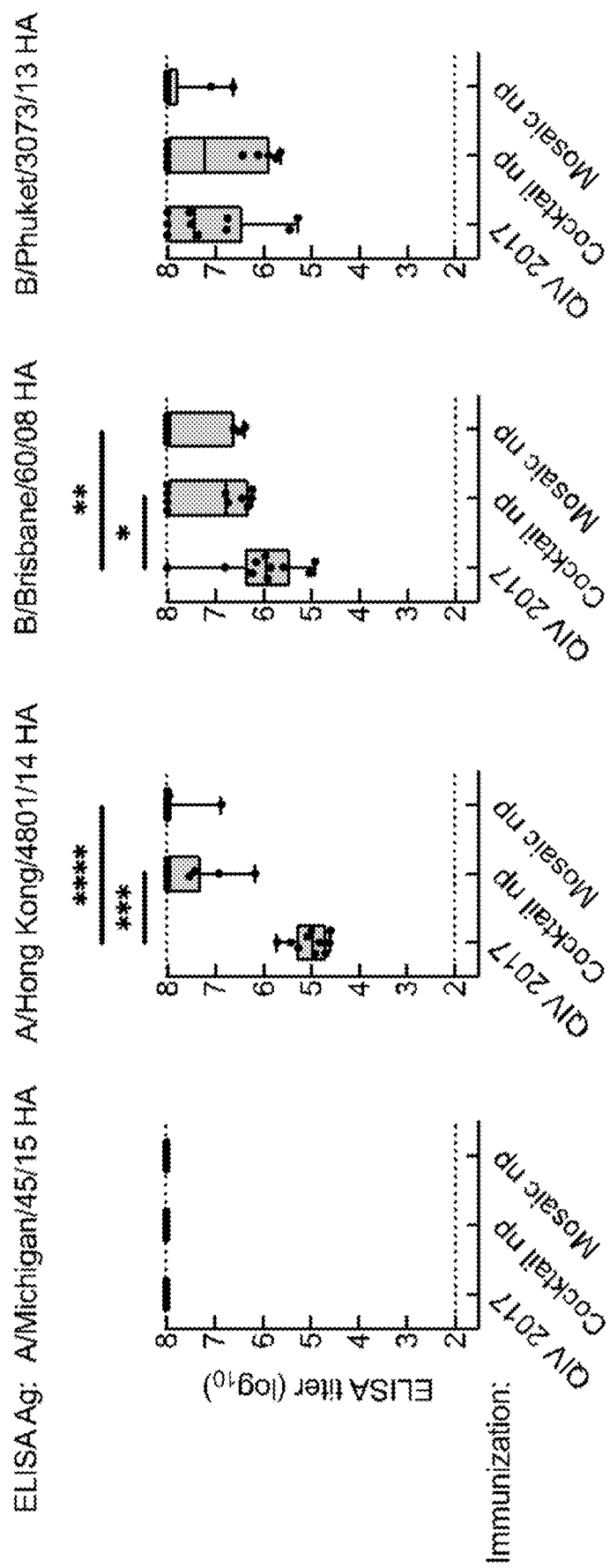

Similarly, serum antibody titer to HAs was measured by ELISA at 2 weeks after the third immunization (week 10) with Addavax™-adjuvanted immunogens at 0.6 µg (FIG. 2C) or 0.06 µg (FIG. 2D). Both cocktail and mosaic nanoparticles were immunogenic in mice in the presence or absence of Addavax™ adjuvant and elicited comparable or superior HA-binding antibody responses to all four vaccine-matched virus HAs compared to the commercial vaccine.

FIGS. 3A and 3B show virus-neutralizing antibody titer to homologous virus in mice measured at 2 weeks after the third immunization (week 10) with either 6 µg Addavax™-adjuvanted immunogens (FIG. 3A) or 6 µg immunogens without adjuvant (FIG. 3B) by a reporter-based MN assay. Both cocktail and mosaic nanoparticles elicited comparable or superior virus neutralizing antibody responses to vaccine-matched H1N1, H3N2, and influenza B viruses compared to the commercial vaccine.

Hemagglutination inhibitory (HAI) antibody titer to homologous virus was also compared in the mice immunized with 6 µg of commercial QIV 2017, cocktail nanoparticles, or mosaic nanoparticles. FIG. 4 shows the serum HAI antibody titer measured at 2 weeks after the third immunization (week 10) with Addavax™-adjuvanted immunogens using Turkey red blood cells. Both cocktail and mosaic nanoparticles elicited comparable or superior hemagglutination inhibitory antibody responses to vaccine-matched H1N1 and 2 lineages of influenza B viruses compared to the commercial vaccine.

Antibody responses to heterosubtypic virus HAs were also measured in the mice immunized with 6 µg of commercial QIV 2017, cocktail nanoparticles, or mosaic nanoparticles with Addavax™ adjuvant. The serum antibody titer was measured at 2 weeks after the third immunization (week 10). FIG. 5A shows the serum antibody titer to heterosubtypic HAs measured by ELISA. FIG. 5B shows the neutralizing antibody titer to H5N1 or H7N9 pseudoviruses, measured by pseudotype virus neutralization assays. Both cocktail and mosaic nanoparticles elicited significantly higher heterosubtypic HA-binding antibody responses to H5N1, H6N1, H7N9, and H10N8 virus HAs than the commercial vaccine. Serum neutralizing activity to heterosubtypic H5N1 and H7N9 pseudoviruses was also detected in both cocktail- and mosaic nanoparticle-immunized mice but not in animals immunized with commercial vaccine.

The mice immunized with 6 µg of commercial QIV 2017, cocktail nanoparticles, or mosaic nanoparticles were challenged with vaccine-mismatched H3N2 and heterosubtypic H5N1 viruses at 10-14 weeks after the third immunization (week 18-22). The survival curve after experimental virus infection was plotted on Kaplan-Meier plots. FIG. 6A shows the survival curve for mice previously immunized with either Addavax™-adjuvanted immunogens (left) or immunogens without an adjuvant (right) and challenged with vaccine-mismatched H3N2. FIG. 6B shows the survival curve for mice previously immunized with either Addavax™-adjuvanted immunogens (left) or immunogens without an adjuvant (right) and challenged with heterosubtypic H5N1 virus. Both cocktail and mosaic nanoparticles adjuvanted with Addavax® conferred complete protection in immunized mice experimentally challenged with vaccine-mismatched H3N2 and heterosubtypic H5N1 viruses, whereas commercial vaccine provided only partial or no protection against the H3N2 or H5N1, respectively. Although protective efficacy against vaccine-mismatched H3N2 infection decreased, both the cocktail and the mosaic nanoparticles provided complete protection against the H5N1 infection in immunized mice in the absence of adjuvant, while commercial vaccine showed no protection to either the H3N2 or H5N1 challenge with no adjuvant.

The HA-binding antibody titer to homologous virus HAs was measured by ELISA periodically after immunizations in serum from the mice immunized with 6 µg of commercial QIV 2017, cocktail nanoparticles, or mosaic nanoparticles with Addavax™ adjuvant. The immunizations were given at weeks 0, 4, and 24. FIG. 7 shows that both the cocktail and the mosaic nanoparticles elicited higher and more durable antibody responses to vaccine-matched virus HAs after two doses of immunizations than the commercial vaccine. Although overall antibody titers waned over time, the third immunization boosted titers to all the HAs to peak titers.

Similarly, HA-binding antibody titers to antigen-mismatched and heterosubtypic virus HAs were measured by ELISA in mice immunized with 6 µg of commercial QIV 2017, cocktail nanoparticles, or mosaic nanoparticles with Addavax™ adjuvant. Serum antibody titer to various group 1 HAs (FIG. 8A) and group 2 HAs (FIG. 8B) was measured at 2 weeks after the third immunization (week 26). Both the cocktail and the mosaic nanoparticle elicited significantly-higher antibody responses to vaccine-mismatched and heterosubtypic virus HAs at week 26 (which is 2 weeks after the third boost in this study) than the commercial vaccine.

Antibody responses to the stem region of HA in mice immunized with 6 µg of commercial QIV 2017, cocktail nanoparticles, or mosaic nanoparticles with Addavax™ adjuvant. FIG. 9 shows the serum antibody titer to group 1 stem-only HA measured by ELISA 2 weeks after the third immunization (week 26). Both cocktail and mosaic nanoparticles elicited significantly higher antibody responses to the invariable stem region of HA, which is the target of most broadly-neutralizing antibodies, than the commercial vaccine.

The HA-binding antibody titer to homologous virus HAs was also measured in rhesus macaques immunized with 60 µg of commercial QIV 2017, cocktail nanoparticles, or mosaic nanoparticles with Addavax™ adjuvant. FIG. 10 shows the serum antibody titer to homologous HAs was measured by ELISA at 4 weeks after the first (week 4) and 2 and 4 weeks after the second immunization (weeks 10 and 12, respectively). Both the cocktail and the mosaic nanoparticles were immunogenic in nonhuman primates in the presence of Addavax™ adjuvant and elicited comparable HA-binding antibody responses to all four vaccine-matched virus HAs, even after the first dose, compared to commercial vaccine. In these mice, the serum neutralizing antibody titer to homologous viruses was also measured. FIG. 11 shows the serum neutralizing antibody titer by reporter-based microneutralization (MN) assays before immunization (week 0), and at 4 weeks after the first (week 4), and 2 weeks after the second immunization (week 10). Both the cocktail and the mosaic nanoparticles elicited comparable virus-neutralizing antibody responses to vaccine-matched H1N1, H3N2, and influenza B viruses, even after the first dose, compared to the commercial vaccine. The HAI antibody titer to homologous viruses was also measured in these rhesus macaques. FIG. 12 shows the serum HAI antibody titer to the homologous viruses measured using Turkey red blood cells at 2 weeks after the second immunizations (weeks 10). Both the cocktail and the mosaic nanoparticles elicited comparable virus HAI antibody responses to vaccine-matched H1N1 and 2 lineages of influenza B viruses compared to the commercial vaccine. The serum antibody titer to heterosubtypic HAs was also measured by ELISA in these rhesus macaques at 2 weeks after the second immunization (week 10). FIG. 13 shows that both the cocktail and the mosaic nanoparticles elicited heterosubtypic HA-binding antibody responses to H5N1, H6N1, H7N9, and H10N8 virus HAs after two doses compared to the commercial vaccine.

Ferrets were also immunized with 20 µg of the commercial QIV 2017, the cocktail of nanoparticles of this disclosure, or the mosaic nanoparticles of this disclosure, with Addavax™ adjuvant. FIG. 14 shows the serum antibody titer to homologous HAs measured by ELISA at 2 weeks after the second immunization (week 6). Both the cocktail and mosaic nanoparticles were immunogenic in ferrets in the presence of Addavax™ adjuvant and elicited comparable HA-binding antibody responses to all four vaccine-matched virus HAs compared to the commercial vaccine. FIG. 15 shows the serum HA-binding antibody titer to heterosubtypic HAs was measured by ELISA in these ferrets at 2 weeks after the second immunization (week 6). The mosaic nanoparticle elicited detectable heterosubtypic HA-binding antibody responses to H5N1 and H7N9 virus HAs after two doses, compared to the commercial vaccine.

HA-binding antibody titers to homologous virus HAs were measured in mice immunized with 6 µg of multi-subtypic cocktail nanoparticles (i.e., cocktail nanoparticles comprising multiple HA antigens from different HA subtypes), or mosaic nanoparticles with Addavax™ adjuvant. The 8× cocktail nanoparticles consisted of eight separate nanoparticles each displaying unique HA on its surface. The 8× mosaic nanoparticle displays the same set of eight different HAs on each particle. The 3-3-2 mosaic nanoparticles consist of three separate particles each displays either three different group 1 HAs, three different group 2 HAs, or two different influenza B HAs on its surface. FIG. 16 shows the serum antibody titer to the different HAs measured by ELISA at 2 weeks after the third immunization (week 10) with Addavax™-adjuvanted immunogens. The multi-specific cocktail and the mosaic nanoparticles elicited strong HA-binding antibody responses to all eight vaccine-matched virus HAs. The antibody responses to the stem region of HA were measured in these mice immunized with 6 µg of multi-subtypic cocktail nanoparticles, or mosaic nanoparticles with Addavax™ adjuvant. FIG. 17 shows the serum antibody titer to group 1 stem-only HA (left) and group 2 stem-only HA (right) measured by ELISA at 2 weeks after the third immunization (week 10) by ELISA. The multi-specific cocktail and mosaic nanoparticles elicited antibody responses to the invariable stem region of HA, which is the target of most broadly neutralizing antibodies, for both group 1 and group 2 viruses.

The HA-binding antibody titer to homologous and heterosubtypic virus HAs was measured in mice immunized with 6 µg of commercial TIV 2011, stem cocktail nanoparticles, or stem mosaic nanoparticles with Addavax™ adjuvant. The stem cocktail nanoparticles consist of four separate nanoparticles each displaying unique stem-only HA (two group 1 and two group 2 stem-only HA) on its surface. The stem mosaic nanoparticle displays the same set of four different stem-only HAs on each particle. FIG. 18 shows the serum antibody titer to HAs measured by ELISA at 2 weeks after the third immunization (week 10) with Addavax™-adjuvanted immunogens. Both the stem cocktail and the mosaic nanoparticles elicited strong HA-binding antibody responses across multiple subtype HAs from both group 1 and group 2 unlike the commercial vaccine, which elicited mostly subtype-specific antibody responses. The HA-binding antibody titer to influenza B virus HA was measured by ELISA in these mice at 2 weeks after the third immunization (week 10) with Addavax™-adjuvanted immunogens. FIG. 19 shows that both the stem cocktail and the mosaic nanoparticles elicited detectable HA-binding antibody responses to highly divergent influenza B HAs, although the immunogens were designed based on the stem of influenza A HAs.

FIG. 20 shows SEC profiles that demonstrate increased expression of I53-dn5 A.1 (LF4_W16G) (FIG. 20B) compared with the original I53-dn5 A (FIG. 20A), which is provided by removal of cysteines and addition of other mutations. Both proteins were expressed in 1 L of E. coli culture and purified by nickel-affinity chromatography prior to SEC on Superdex™75 Increase 10/300 column (GE Healthcare).

FIG. 21 shows purification and assembly of I53-dn5 A.2 (LF2_W16G_LS) pentameric component that was secreted from HEK293F mammalian cell culture. After expression and purification from cell supernatant by nickel-affinity chromatography, SEC of secreted I53-dn5 A.2 pentameric component on a Superdex™ 200 Increase 10/300 column (GE Healthcare) demonstrated correct size (FIG. 21A). Mixing the SEC-purified I53-dn5 A.2 with I53-dn5 B trimer successfully assembled nanoparticles which were validated by SEC on a Superose™ 6 Increase 10/300 column (GE Healthcare) (FIG. 21B). Correct identity of proteins at all steps was confirmed by SDS-PAGE (FIG. X2 C).

While certain example embodiments have been described, these embodiments have been presented by way of example only, and are not intended to limit the scope of the inventions disclosed herein. Thus, nothing in the foregoing description is intended to imply that any particular feature, characteristic, or step is necessary or indispensable. The novel methods and compositions described herein may be embodied in a variety of other forms; furthermore, various omissions, substitutions and changes in the form of the methods and systems described herein may be made without departing from the spirit of the inventions disclosed herein. The accompanying claims and their equivalents are intended to cover such forms or modifications as would fall within the scope and spirit of the inventions disclosed herein.

SEQUENCE LISTING (349 sequences)

SEQ ID NO: 1 - protein, 517 aa, Influenza Virus
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKID

SEQ ID NO: 2 - protein, 233 aa, Influenza Virus
CLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDEC

SEQ ID NO: 3 - protein, 53 aa, Influenza Virus
KVNSVIEKMNTQFTAVGKEFNKLERRMENLNKKVDDGFLDIWTYNAELLVLLE

SEQ ID NO: 4 - protein, 515 aa, Influenza Virus
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNRE

SEQ ID NO: 5 - protein, 234 aa, Influenza Virus
CKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDC

SEQ ID NO: 6 - protein, 53 aa, Influenza Virus
KVNSVIEKMNTQFTAVGKEFNHLEKRIENLNKKVDDGFLDIWTYNAELLVLLE

SEQ ID NO: 7 - protein, 517 aa, Influenza Virus
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQ

SEQ ID NO: 8 - protein, 226 aa, Influenza Virus
CDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKC

SEQ ID NO: 9 - protein, 53 aa, Influenza Virus
KLNRLIGKTNEKFHQIEKEFSEVEGRIQDLEKYVEDTKIDLWSYNAELLVALE

SEQ ID NO: 10 - protein, 539 aa, Influenza Virus
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASA

SEQ ID NO: 11 - protein, 242 aa, Influenza Virus
CPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADC

SEQ ID NO: 12 - protein, 56 aa, Influenza Virus
KNLNSLSELEVKNLQRLSGAMDELHNEILELDEKVDDLRADTISSQIELAVLLSNE

SEQ ID NO: 13 - protein, 538 aa, Influenza Virus
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASA

SEQ ID NO: 14 - protein, 241 aa, Influenza Virus
CPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADC

SEQ ID NO: 15 - protein, 56 aa, Influenza Virus; identical to SEQ ID NO: 12

SEQ ID NO: 16 - protein, 518 aa, Influenza Virus
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCFPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMIDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVSA

SEQ ID NO: 17 - protein, 232 aa, Influenza Virus
CKLNGIPPLELGDCSIAGWLLGNPECDRLLSVPEWSYIMEKENPRDGLCFPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVGTYVSVGTSTLNKRSTPDIATRPKVNGLGSRMEFSWTLLDMWDTINFESTGNLIAPEYGFKISKRGSSGIMKTEGTLENC

SEQ ID NO: 18 - protein, 53 aa, Influenza Virus
KVNSVIEKMNTQFEAVGKEFSNLERRLENLNKKMEDGFLDVWTYNAELLVLME

SEQ ID NO: 19 - protein, 520 aa, Influenza Virus
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCFPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVSA

SEQ ID NO: 20 - protein, 233 aa, Influenza Virus
CDLDGVKPLILRDCSVAGWLLGNPMCDEFINVPEWSYIVEKANPTNDLCFPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNC

SEQ ID NO: 21 - protein, 53 aa, Influenza Virus
KVNSIIDKMNTQFEAVGREFNNLERRIENLNKKMEDGFLDVWTYNAELLVLME

SEQ ID NO: 22 - protein, 523 aa, Influenza Virus
MIAIVVIAILASAGKSDKICIGYHANNSTTQVDTLLEKNVTVTHSVELLENQKEKRFCKIMNKAPLDLKDCTIEGWILGNPKCDLLLGDQSWSYIVERPNAQNGICFPGVLNELEELKAFIGSGERVERFEMFPKSTWAGVDTSRGVTNACPSYTIDSSFYRNLVWIVKTDSATYPVIKGTYNNTGTQPILYFWGVHHPLDTTVQDNLYGSGDKYVRMGTESMNFAKSPEIAARPAVNGQRSRIDYYWSVLRPGETLNVESNGNLIAPWYAYKFVSTNKKGAVFKSDLPIENCDATCQTITGVLRTNKTFQNVSPLWIGECPKYVKSESLRLATGLRNVPQIATRGIFGAIAGFIEGGWTGMIDGWYGYHHENSQGSGYAADRESTQKAIDGITNKVNSIINKMNTQFEAVDHEFSNLERRIGNLNKRMEDGFLDVWTYNAELLVLLENERTLDLHDANVKNLYEKVKSQLRDNANDLGNGCFEFWHKCDNECMESVKNGTYDYPKYQKESKLNRQGIESVSA

SEQ ID NO: 23 - protein, 236 aa, Influenza Virus
CKIMNKAPLDLKDCTIEGWILGNPKCDLLLGDQSWSYIVERPNAQNGICFPGVLNELEELKAFIGSGERVERFEMFPKSTWAGVDTSRGVTNACPSYTIDSSFYRNLVWIVKTDSATYPVIKGTYNNTGTQPILYFWGVHHPLDTTVQDNLYGSGDKYVRMGTESMNFAKSPEIAARPAVNGQRSRIDYYWSVLRPGETLNVESNGNLIAPWYAYKFVSTNKKGAVFKSDLPIENC

SEQ ID NO: 24 - protein, 53 aa, Influenza Virus
KVNSIINKMNTQFEAVDHEFSNLERRIGNLNKRMEDGFLDVWTYNAELLVLLE

SEQ ID NO: 25 - protein, 517 aa, Influenza Virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCFPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVSA

SEQ ID NO: 26 - protein, 227 aa, Influenza Virus
CSKGKRTVDLGQCGLLGTITGPPQCDQFLEFSADLIIERREGSDVCFPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANC

SEQ ID NO: 27 - protein, 53 aa, Influenza Virus
KLNRLIEKTNQQFELIDNEFNEVEKQIGNVINWTRDSITEVWSYNAELLVAME

SEQ ID NO: 28 - protein, 516 aa, Influenza Virus
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCFPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYDRRKYREESRLERQRIEGVSA

SEQ ID NO: 29 - protein, 227 aa, Influenza Virus
CATNLGHPLILDTCTIEGLIYGNPSCDLLLEGREWSYIVERPSAVNGTCFPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNC

SEQ ID NO: 30 - protein, 53 aa, Influenza Virus
KVNNIVDKMNKQYEIIDHEFSEVETRLNMINNKIDDQIQDVWAYNAELLVLLE

SEQ ID NO: 31 - protein, 518 aa, Influenza Virus
MYKIVVIIALLGAVKGLDKICLGHHAVANGTIVKTLTNEQEEVTNATETVESTGINRLCMKGRKHKDLGNCHPIGMLIGTPACDLHLTGMWDTLIERENAIAYCFPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVSA

SEQ ID NO: 32 - protein, 229 aa, Influenza Virus
CMKGRKHKDLGNCHPIGMLIGTPACDLHLTGMWDTLIERENAIAYCFPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNC

SEQ ID NO: 33 - protein, 53 aa, Influenza Virus
KLNRLVEKTNTEFESIESEFSEIEHQIGNVINWTKDSITDIWTYQAELLVAME

SEQ ID NO: 34 - protein, 525 aa, Influenza Virus
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCFPYDVPDYASLRSLVASSGTLEFKNESFNWTGVTQNGTSSACIRGSSSSFFSRLNWLTHLNYTYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIESIRNETYDHNVYRDEALNNRFQIKGVGGSA

SEQ ID NO: 35 - protein, 226 aa, Influenza Virus
CDSPHQILDGENCTLIDALLGDPQCDGFQNKKWDLFVERSKAYSNCFPYDVPDYASLRSLVASSGTLEFKNESFNWTGVTQNGTSSACIRGSSSSFFSRLNWLTHLNYTYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKC

SEQ ID NO: 36 - protein, 53 aa, Influenza Virus
KLNRLIGKTNEKFHQIEKEFSEVEGRVQDLEKYVEDTKIDLWSYNAELLVALE

SEQ ID NO: 37 - protein, 537 aa, Influenza Virus
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASA

SEQ ID NO: 38 - protein, 240 aa, Influenza Virus
CPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADC

SEQ ID NO: 39 - protein, 56 aa, Influenza Virus; identical to SEQ ID NO: 12

SEQ ID NO: 40 - DNA, 465 bp, Artificial Sequence
  Synthetic
atgggcaaatacgacggatccaaactccgcataggcatcctccacgcccgatggaacgcagaaatcatactcgccctagtactaggcgccctaaaacgcctccaagaattcggcgtaaaacgagaaaacataatcatcgaaacagtccccggctcattcgaactaccctacggctcaaaactcttcgtcgaaaaacaaaaacgactcggaaaaccactcgacgcaatcatccccatcggagtactcatcaaaggctccacaatgcacttcgaatacatctgcgactcaacaacacaccaactcatgaaactcaacttcgaactaggcataccagtcatcttcggagtcctaacatgcctcaccgacgaacaagccgaagcccgcgccggactcatcgaaggaaaaatgcacaaccacggcgaagactggggcgcagccgccgtcgaaatggccacaaaattcaac

SEQ ID NO: 41 - protein, 155 aa, Artificial Sequence
  Synthetic
MGKYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFN

SEQ ID NO: 42 - DNA, 465 bp, Artificial Sequence
  Synthetic
atgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagcccgcgccggactcatcgaaggaaaaatgcacaaccacggcgaagactggggcgcagccgccgtcgaaatggccacaaaattcaac

SEQ ID NO: 43 - protein, 155 aa, Artificial Sequence
  Synthetic
MGKYDGSKLRIGILHARGNAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFN

SEQ ID NO: 44 - DNA, 456 bp, Artificial Sequence
  Synthetic
atgggcaaatacgacggatccaaactccgcataggcatcctccacgcccgaggaaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 45 - protein, 152 aa, Artificial Sequence
  Synthetic
MGKYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

SEQ ID NO: 46 - DNA, 465 bp, Artificial Sequence
  Synthetic
atgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagcccgcgccggactcatcgaaggaaaaatgcacaaccacggcgaagactggggcgcagccgccgtcgaaatggccacaaaattcaac

SEQ ID NO: 47 - protein, 155 aa, Artificial Sequence
  Synthetic
MGKYDGSKLRIGILHARGNAEIILALVLGALKRLQEFGVKRENIIIETVPGSFELPYGSKLFVEKQKRKGEPLDAIIPIGVLIRGSTAHFDYIADSTTHQLMKLNFELGIPVIFGVLTTESDEQAEARAGLIEGKMHNHGEDWGAAAVEMATKFN

SEQ ID NO: 48 - DNA, 456 bp, Artificial Sequence
  Synthetic
atgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 49 - protein, 152 aa, Artificial Sequence
  Synthetic
MGKYDGSKLRIGILHARENAEIILELVLGALKRLQEFGVKRENIIIETVPGSFELPYGSKLFVEKQKRKGEPLDAIIPIGVLIRGSTPHFDYIADSTTHQLMKLNFELGIPVIFGVITADTDEQAEERAGTKAGNHGEDWGAAAVEMATKFN

SEQ ID NO: 50 - DNA, 465 bp, Artificial Sequence
  Synthetic
atgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagcccgcgccggactcatcgaaggaaaaatgcacaaccacggcgaagactggggcgcagccgccgtcgaaatggccacaaaattcaac

SEQ ID NO: 51 - protein, 155 aa, Artificial Sequence
  Synthetic
MGKYDGSKLRIGILHARGNAEIILALVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEARAGLIEGKMHNHGEDWGAAAVEMATKFN

SEQ ID NO: 52 - DNA, 456 bp, Artificial Sequence
  Synthetic
atgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 53 - protein, 152 aa, Artificial Sequence
  Synthetic
MGKYDGSKLRIGILHARENAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

SEQ ID NO: 54 - DNA, 465 bp, Artificial Sequence
  Synthetic
atgggcaaatacgacggatccaaactccgcataggcatcctccacgcccgagagaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagcccgcgccggactcatcgaaggaaaaatgcacaaccacggcgaagactggggcgcagccgccgtcgaaatggccacaaaattcaac

SEQ ID NO: 55 - protein, 155 aa, Artificial Sequence
  Synthetic
MGKYDGSKLRIGILHARENAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFN

SEQ ID NO: 56 - DNA, 456 bp, Artificial Sequence
  Synthetic
atgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 57 - protein, 152 aa, Artificial Sequence
  Synthetic
MGKYDGSKLRIGILHARENAEIILELVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEERAGTKAGNHGEDWGAAAVEMATKFN

SEQ ID NO: 58 - DNA, 456 bp, Artificial Sequence
  Synthetic
atgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 59 - protein, 152 aa, Artificial Sequence
  Synthetic
MGKYDGSKLRIGILHARENAEIILELVLGALKRLQEFGVKRENIIIETVPGSFELPYGSKLFVEKQKRKGEPLDAIIPIGVLIRGSTAHFDYIADSTTHQLMKLNFELGIPVIFGVLTTESDEQAEERAGTKAGNHGEDWGAAAVEMATKFN

SEQ ID NO: 60 - DNA, 465 bp, Artificial Sequence
  Synthetic
atgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagcccgcgccggactcatcgaaggaaaaatgcacaaccacggcgaagactggggcgcagccgccgtcgaaatggccacaaaattcaac

SEQ ID NO: 61 - protein, 155 aa, Artificial Sequence
  Synthetic
MGKYDGSKLRIGILHARGNAEIILALVLGALKRLQEFGVKRENIIIETVPGSFELPYGSKLFVEKQKRKGEPLDAIIPIGVLIRGSTPHFDYIADSTTHQLMKLNFELGIPVIFGVITADTDEQAEARAGLIEGKMHNHGEDWGAAAVEMATKFN

SEQ ID NO: 62 - DNA, 465 bp, Artificial Sequence
  Synthetic
atgggcaaatacgacggatccaaactccgcataggcatcctccacgcccgagagaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagcccgcgccggactcatcgaaggaaaaatgcacaaccacggcgaagactggggcgcagccgccgtcgaaatggccacaaaattcaac

SEQ ID NO: 63 - protein, 155 aa, Artificial Sequence
  Synthetic
MGKYDGSKLRIGILHARENAEIILALVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEARAGLIEGKMHNHGEDWGAAAVEMATKFN

SEQ ID NO: 64 - DNA, 456 bp, Artificial Sequence
  Synthetic
atgggcaaatacgacggatccaaactccgcataggcatcctccacgcccgaggaaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 65 - protein, 152 aa, Artificial Sequence
  Synthetic
MGKYDGSKLRIGILHARGNAEIILELVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEERAGTKAGNHGEDWGAAAVEMATKFN

SEQ ID NO: 66 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgaggaaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 67 - protein, 177 aa, Artificial Sequence
  Synthetic
METDTLLLWVLLLWVPGSTGDYKDEMGKYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

SEQ ID NO: 68 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgaggaaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 69 - protein, 177 aa, Artificial Sequence
  Synthetic
METDTLLLWVLLLWVPGSTGDYKDEMGKYDGSKLRIGILHARGNAEIILELVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEERAGTKAGNHGEDWGAAAVEMATKFN

SEQ ID NO: 70 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 71 - protein, 177 aa, Artificial Sequence
  Synthetic
METDTLLLWVLLLWVPGSTGDYKDEMGKYDGSKLRIGILHARENAEIILELVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEERAGTKAGNHGEDWGAAAVEMATKFN

SEQ ID NO: 72 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 73 - protein, 177 aa, Artificial Sequence
  Synthetic
METDTLLLWVLLLWVPGSTGDYKDEMGKYDGSKLRIGILHARENAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

SEQ ID NO: 74 - DNA, 540 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagcccgcgccggactcatcgaaggaaaaatgcacaaccacggcgaagactggggcgcagccgccgtcgaaatggccacaaaattcaac

SEQ ID NO: 75 - protein, 180 aa, Artificial Sequence
  Synthetic
METDTLLLWVLLLWVPGSTGDYKDEMGKYDGSKLRIGILHARENAEIILALVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEARAGLIEGKMHNHGEDWGAAAVEMATKFN

SEQ ID NO: 76 - DNA, 540 bp, Artificial Sequence; identical to SEQ ID NO: 74
  Synthetic

SEQ ID NO: 77 - protein, 180 aa, Artificial Sequence; identical to SEQ ID NO: 75
  Synthetic

SEQ ID NO: 78 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagagcgcgccggaactaaggcaggtaaccacggcgaagactggggcgcagccgccgtcgaaatggccacaaaattcaac

SEQ ID NO: 79 - protein, 177 aa, Artificial Sequence
  Synthetic
METDTLLLWVLLLWVPGSTGDYKDEMGKYDGSKLRIGILHARENAEIILELVLGALKRLQEFGVKRENIIIETVPGSFELPYGSKLFVEKQKRKGEPLDAIIPIGVLIRGSTAHFDYIADSTTHQLMKLNFELGIPVIFGVLTTESDEQAEERAGTKAGNHGEDWGAAAVEMATKFN

SEQ ID NO: 80 - DNA, 531 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgaactagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagagcgcgccggaactaaggcaggtaaccacggcgaagactggggcgcagccgccgtcgaaatggccacaaaattcaac

SEQ ID NO: 81 - protein, 177 aa, Artificial Sequence
  Synthetic
METDTLLLWVLLLWVPGSTGDYKDEMGKYDGSKLRIGILHARENAEIILELVLGALKRLQEFGVKRENIIIETVPGSFELPYGSKLFVEKQKRKGEPLDAIIPIGVLIRGSTPHFDYIADSTTHQLMKLNFELGIPVIFGVITADTDEQAEERAGTKAGNHGEDWGAAAVEMATKFN

SEQ ID NO: 82 - DNA, 540 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagcccgcgccggactcatcgaaggaaaaatgcacaaccacggcgaagactggggcgcagccgccgtcgaaatggccacaaaattcaac

SEQ ID NO: 83 - protein, 180 aa, Artificial Sequence
  Synthetic
METDTLLLWVLLLWVPGSTGDYKDEMGKYDGSKLRIGILHARGNAEIILALVLGALKRLQEFGVKRENIIIETVPGSFELPYGSKLFVEKQKRKGEPLDAIIPIGVLIRGSTPHFDYIADSTTHQLMKLNFELGIPVIFGVITADTDEQAEARAGLIEGKMHNHGEDWGAAAVEMATKFN

SEQ ID NO: 84 - DNA, 540 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgagagaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgactcggaaaaccactcgacgcaatcatccccatcggagtactcatccgcggctccacaccacacttcgactacatcgcagactcaacaacacaccaactcatgaaactcaacttcgaactaggcataccagtcatcttcggagtcatcacagcagacactgacgaacaagccgaagcccgcgccggactcatcgaaggaaaaatgcacaaccacggcgaagactggggcgcagccgccgtcgaaatggccacaaaattcaac

SEQ ID NO: 85 - protein, 180 aa, Artificial Sequence
  Synthetic
METDTLLLWVLLLWVPGSTGDYKDEMGKYDGSKLRIGILHARENAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFN

SEQ ID NO: 86 - DNA, 540 bp, Artificial Sequence
  Synthetic
atggaaacagatactcttttgttgtgggttctcctcctgtgggttccagggtcaaccggggactacaaggacgagatgggcaaatacgacggatccaaactccgcataggcatcctccacgcccgaggaaacgcagaaatcatactcgccctagtactaggcgccctaaaacgcctccaagaattcggcgtaaaacgagaaaacataatcatcgaaacagtccccggctcattcgagctaccctacggctcaaaactcttcgtcgaaaaacaaaaacgaaagggtgaaccactcgacgcaatcatccccatcggagtactcatccgcggctccacagcacacttcgactacatcgcagactcaacaacacaccaactcatgaaactcaacttcgaactaggcataccagtcatcttcggagtcctaacaactgagtcagacgaacaagccgaagcccgcgccggactcatcgaaggaaaaatgcacaaccacggcgaagactggggcgcagccgccgtcgaaatggccacaaaattcaac

SEQ ID NO: 87 - protein, 180 aa, Artificial Sequence
  Synthetic
METDTLLLWVLLLWVPGSTGDYKDEMGKYDGSKLRIGILHARGNAEIILALVLGALKRLQEFGVKRENIIIETVPGSFELPYGSKLFVEKQKRKGEPLDAIIPIGVLIRGSTAHFDYIADSTTHQLMKLNFELGIPVIFGVLTTESDEQAEARAGLIEGKMHNHGEDWGAAAVEMATKFN

SEQ ID NO: 88 - DNA, 357 bp, Artificial Sequence
  Synthetic
gaggaggccgagctggcctacctgctgggcgagctggcctacaagctgggcgagtatcggatcgccatcagggcatacaggatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaacgcaaagatgagagaagaa

SEQ ID NO: 89 - protein, 119 aa, Artificial Sequence
  Synthetic
EEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 90 - DNA, 1917 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaatacctgcatggaaagcgtgaaaaacgggacctacgattaccctaaatacagcgaggaagccaaactgaacagggagggatccggctccggagaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaatgccaaaatgagagaggag

SEQ ID NO: 91 - protein, 639 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREGSGSGEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 92 - DNA, 1932 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaaatgcgacaacacctgtatggaaagcgtgaaaaatgggacttacgactaccctaaatactcagaggaagccaaactgaaccgggagaagatcgacggagtgggaggagctagcgccgaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaacgctaaaatgcgagaagaa

SEQ ID NO: 93 - protein, 644 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVGGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 94 - DNA, 1935 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtattccgaggaggccaagctgaaccgggagaagatcgacggcgtgccccctggcgctagcgccgaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaacgctaaaatgcgagaagaa

SEQ ID NO: 95 - protein, 645 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 96 - DNA, 1935 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtattccgaggaggccaagctgaaccgggagaagatcgacggctttccccctggcgctagcgccgaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaacgctaaaatgcgagaagaa

SEQ ID NO: 97 - protein, 645 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGFPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 98 - DNA, 1935 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtattccgaggaggccaagctgaaccgggagaagatcgacggcatcccccctggcgctagcgccgaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaacgctaaaatgcgagaagaa

SEQ ID NO: 99 - protein, 645 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGIPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 100 - DNA, 1935 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtattccgaggaggccaagctgaaccgggagaagatcgacggctggccccctggcgctagcgccgaggaggccgagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaacaatgccgatgccatgcagaatctgctgaacgctaaaatgcgagaagaa

SEQ ID NO: 101 - protein, 645 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGWPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 102 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagagagaagatcgacggcgtgtctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 103 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 104 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagagagaagatcgacggagtgaaggcagaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 105 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 106 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagggagaagatcgacggcgtgcgcgcagaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 107 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVRAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 108 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagagagaagatcgacggcttttctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 109 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGFSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 110 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagagagaagatcgacggctttaaggcagaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 111 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGFKAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 112 - DNA, 1923 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagggagaagatcgacggctttcgcgcagaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 113 - protein, 641 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGFRAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 114 - DNA, 1923 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaagactaaaaaacagctgcgggaaaacgccgaggacatgggcaatggatgcttcaaaatctatcataagtgcgacaacgcctgtattggctctatcaggaacggcacctacgaccacaacgtgtacagggatgaggccctgaacaatcgcttccagggatccggctccggagaggaggcagagctggcctacctgctgggcgagctggcctacaagctgggcgagtatcggatcgccatcagggcatacaggatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaacgctaagatgagagaggag

SEQ ID NO: 115 - protein, 641 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQGSGSGEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 116 - DNA, 1926 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaaaaccaagaaacagctgagggaaaacgccgaggacatgggcaacgggtgcttcaaaatctatcacaaatgcgacaacgcctgtattggcagcatcaggaacggcacctacgaccacaacgtgtacagggatgaggccctgaacaatcgcttcggaccacctggagctagcgccgaggaggccgagctggcctacctgctgggcgagctggcctacaagctgggcgagtatcggatcgccatcagggcatacaggatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaacgcaaagatgagagaagaa

SEQ ID NO: 117 - protein, 642 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFGPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 118 - DNA, 1929 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaaaaccaagaaacagctgcgcgagaacgccgaagacatgggcaatgggtgttttaaaatctaccacaaatgcgataacgcttgtatcgggagcatccggaacggaacatacgaccataatgtctatagggatgaggccctgaacaatcgctttcagggccccccaggagctagcgccgaggaggccgagctggcctacctgctgggcgagctggcctacaagctgggcgagtatcggatcgccatcagggcatacaggatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaacgcaaagatgagagaagaa

SEQ ID NO: 119 - protein, 643 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQGPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 120 - DNA, 1929 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaaaaccaagaaacagctgagggagaacgcagaagacatgggcaatgggtgttttaaaatctaccacaaatgcgataacgcttgtatcgggagcattcgcaatggaacatacgaccataatgtctacagggatgaggccctgaacaatcgcttccagattccaccaggcgctagcgccgaggaggccgagctggcctacctgctgggcgagctggcctacaagctgggcgagtatcggatcgccatcagggcatacaggatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaacgcaaagatgagagaagaa

SEQ ID NO: 121 - protein, 643 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIPPGASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 122 - DNA, 1926 bp, Artificial Sequence
  Synthetic
atgaaaactattatcgccctgtcatacatcctgtgcctggtctttgctcagaaaatccctggaaacgacaactccaccgccaccctgtgtctgggccaccacgccgtgccaaatggcaccatcgtgaagaccatcacaaacgaccgcatcgaggtgaccaatgccacagagctggtgcagaacagctccatcggcgagatttgcgacagcccccaccagatcctggatggcgagaactgtacactgatcgacgcactgctgggcgaccctcagtgcgatggcttccagaataagaagtgggatctgtttgtggagcgcagcaaggcctactccaactgtttcccctacgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttcccggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccctccagaatctctatctactggaccatcgtgaagccaggcgatatcctgctgatcaactccacaggcaatctgatcgcccccagaggctatttcaagatcaggtccggcaagagctccatcatgaggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaacgtgccagagaagcagaccaggggaatcttcggagcaatcgcaggctttatcgagaatggctgggagggcatggtggacggctggtacggctttagacaccagaactctgagggaaggggacaggcagccgacctgaagagcacccaggccgccatcgatcagatcaacggcaagctgaatagactgatcggcaagacaaatgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaacaagctgttcgaaaagaccaagaagcagctgagggagaacgccgaggacatgggcaatggctgcttcaaaatctaccacaagtgcgataacgcctgtatcggcagcatccgcaacggcacatacgaccacaacgtgtacagggatgaggccctgaacaatcgctttcagatcaagggcgtgtccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 123 - protein, 642 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCFPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 124 - DNA, 1842 bp, Artificial Sequence
  Synthetic
ctgtgtctgggccaccacgccgtgccaaatggcaccatcgtgaagaccatcacaaacgaccgcatcgaggtgaccaatgccacagagctggtgcagaacagctccatcggcgagatttgcgacagcccccaccagatcctggatggcgagaactgtacactgatcgacgcactgctgggcgaccctcagtgcgatggcttccagaataagaagtgggatctgtttgtggagcgcagcaaggcctactccaactgtttcccctacgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttcccggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccctccagaatctctatctactggaccatcgtgaagccaggcgatatcctgctgatcaactccacaggcaatctgatcgcccccagaggctatttcaagatcaggtccggcaagagctccatcatgaggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaacgtgccagagaagcagaccaggggaatcttcggagcaatcgcaggctttatcgagaatggctgggagggcatggtggacggctggtacggctttagacaccagaactctgagggaaggggacaggcagccgacctgaagagcacccaggccgccatcgatcagatcaacggcaagctgaatagactgatcggcaagacaaatgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaacaagctgttcgaaaagaccaagaagcagctgagggagaacgccgaggacatgggcaatggctgcttcaaaatctaccacaagtgcgataacgcctgtatcggcagcatccgcaacggcacatacgaccacaacgtgtacagggatgaggccctgaacaatcgctttcagatcaagggcgtgtccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 125 - protein, 634 aa, Artificial Sequence
  Synthetic
MNTQILVFALIAIIPTNADKLCLGHHAVPNGTIVKTITNDRIEVTNATELVQNSSIGEICDSPHQILDGENCTLIDALLGDPQCDGFQNKKWDLFVERSKAYSNCFPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 126 - DNA, 1932 bp, Artificial Sequence
  Synthetic
atgaaaactattatcgccctgtcatacatcctgtgcctggtctttgctcagaaaatccctggaaacgacaactccaccgccaccctgtgtctgggccaccacgccgtgccaaatggcaccatcgtgaagaccatcacaaacgaccgcatcgaggtgaccaatgccacagagctggtgcagaacagctccatcggcgagatttgcgacagcccccaccagatcctggatggcgagaactgtacactgatcgacgcactgctgggcgaccctcagtgcgatggcttccagaataagaagtgggatctgtttgtggagcgcagcaaggcctactccaactgtttcccctacgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttcccggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccctccagaatctctatctactggaccatcgtgaagccaggcgatatcctgctgatcaactccacaggcaatctgatcgcccccagaggctatttcaagatcaggtccggcaagagctccatcatgaggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaacgtgccagagaagcagaccaggggaatcttcggagcaatcgcaggctttatcgagaatggctgggagggcatggtggacggctggtacggctttagacaccagaactctgagggaaggggacaggcagccgacctgaagagcacccaggccgccatcgatcagatcaacggcaagctgaatagactgatcggcaagacaaatgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaacaagctgttcgaaaagaccaagaagcagctgagggagaacgccgaggacatgggcaatggctgcttcaaaatctaccacaagtgcgataacgcctgtatcggcagcatccgcaacggcacatacgaccacaacgtgtacagggatgaggccctgaacaatcgctttcagatcaagggcgtgggcggctccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 127 - protein, 644 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCFPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVGGSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 128 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 129 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 130 - DNA, 1980 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagccagcctgtccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 131 - protein, 660 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 132 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 133 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 134 - DNA, 1977 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagccagcctgtccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 135 - protein, 659 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 136 - DNA, 1911 bp, Artificial Sequence
  Synthetic
atggctattatctacctgatcctgctgtttaccgccgtgagaggggaccagatttgcatcggataccacgctaacaactccactgaaaaggtggacacaatcctggagcggaacgtgacagtgacccacgccaaggatatcctggagaagacccacaacggcaagctgtgcaagctgaatggcatcccccctctggagctgggcgactgcagcatcgcaggatggctgctgggcaatccagagtgtgataggctgctgtctgtgcccgagtggagctacatcatggagaaggagaaccccagagacggcctgtgcttccctggctcctttaatgattatgaggagctgaagcacctgctgagctccgtgaagcactttgagaaggtgaagatcctgcctaaggacaggtggacccagcacaccacaaccggaggctccagagcatgtgccgtgtccggcaacccttctttctttaggaatatggtgtggctgacagagaagggctctaactacccagtggccaagggctcctataacaatacctctggcgagcagatgctgatcatctggggcgtgcaccaccccaacgacgagaaggagcagcgcacactgtaccagaatgtgggcacctatgtgagcgtgggcacatccaccctgaacaagcggagcacaccagatatcgccaccagacccaaagtgaatggcctgggcagccggatggagttctcctggaccctgctggacatgtgggatacaatcaactttgagtccaccggcaatctgatcgccccagagtacggcttcaagatcagcaagagaggctctagcggcatcatgaagacagagggcaccctggagaactgcgagacaaagtgtcagacccccctgggcgccatcaacacaaccctgccttttcacaatgtgcacccactgacaatcggcgagtgccccaagtatgtgaagtctgagaagctggtgctggcaaccggcctgaggaacgtgcctcagatcgagagccgcggcctgttcggagcaatcgcaggctttatcgagggaggatggcagggaatgatcgacggatggtacggctatcaccactctaatgaccagggcagcggctacgccgccgataaggagagcacacagaaggccttcgatggcatcaccaacaaggtcaattccgtgatcgagaagatgaacacacagttcgaggccgtgggcaaggagttttccaatctggagcggagactggagaacctgaataagaagatggaggacggcttcctggacgtgtggacatataacgccgagctgctggtgctgatggagaatgagaggaccctggacttccacgattctaacgtgaagaatctgtacgacaaggtgaggatgcagctgcgcgataacgtgaaggagctgggcaatggctgtttcgaattctaccacaagtgcgacgatgagtgtatgaactctgtgaagaatggcacctacgactatcccaagtacgaggaggagagcaagctgaacagaaatgagatcaagggcgtgtccgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 137 - protein, 637 aa, Artificial Sequence
  Synthetic
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCFPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMIDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 138 - DNA, 1917 bp, Artificial Sequence
  Synthetic
atggaaaagattgtgctgctgctggctatcgtgtcactggtcaagtcagatcagatttgtatcgggtatcacgctaataattcaaccgagcaggtggacaccatcatggagaagaacgtgaccgtgacacacgcccaggatatcctggagaagacacacaatggcaagctgtgcgacctggatggcgtgaagcccctgatcctgagggactgctctgtggcaggatggctgctgggcaacccaatgtgcgatgagttcatcaatgtgcctgagtggagctacatcgtggagaaggccaaccctaccaatgacctgtgcttcccaggctcctttaacgattatgaggagctgaagcacctgctgtctcggatcaatcactttgagaagatccagatcatcccaaagagctcctggagcgaccacgaggcatctagcggcgtgtcctctgcctgtccctacctgggctctcctagcttctttagaaacgtggtgtggctgatcaagaagaattctacctaccccacaatcaagaagagctataacaataccaaccaggaggacctgctggtgctgtggggcatccaccacccaaacgatgccgccgagcagacaaggctgtaccagaatcccaccacatatatctccatcggcacctctacactgaaccagaggctggtgcctaagatcgccacccgcagcaaggtcaatggccagtccggccgcatggagttcttttggacaatcctgaagcctaacgacgccatcaatttcgagagcaacggcaacttcatcgccccagagtacgcctataagatcgtgaagaagggcgatagcgccatcatgaagtccgagctggagtacggcaactgcaataccaagtgtcagacaccaatgggcgccatcaacagctccatgccattccacaatatccaccccctgaccatcggcgagtgccccaagtatgtgaagtccaaccggctggtgctggccacaggcctgagaaattctcctcagagggagagccgcggcctgttcggagcaatcgcaggctttatcgagggaggatggcagggaatggtggacggctggtacggctatcaccactccaacgagcagggctctggatacgcagcagacaaggagagcacccagaaggccatcgatggcgtgacaaacaaggtcaattccatcatcgataagatgaacacccagttcgaggccgtgggcagggagtttaacaatctggagcggagaatcgagaacctgaataagaagatggaggacggcttcctggacgtgtggacctataacgccgagctgctggtgctgatggagaatgagcgcacactggactttcacgattccaacgtgaagaatctgtacgacaaggtgcggctgcagctgagagataacgccaaggagctgggcaatggctgtttcgaattctaccacaagtgcgacaacgagtgtatggagtctatccggaacggcacctacaattatccccagtacagcgaggaggccaggctgaagagggaggagatcagcggcgtgtccgccgaggaggcagagctggcctacctgctgggcgagctggcctacaagctgggcgagtatcggatcgccatccgggcctatagaatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactataggaaggccctgcgcctggacccaaacaatgccgatgccatgcagaacctgctgaatgcaaagatgagggaggag

SEQ ID NO: 139 - protein, 639 aa, Artificial Sequence
  Synthetic
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCFPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 140 - DNA, 1926 bp, Artificial Sequence
  Synthetic
atgattgctatcgtcgtcattgctattctggcatccgctggaaagtcagacaagatttgcattgggtatcacgctaacaactcaacaacacaggtggacactctgctggagaagaacgtgactgtcacccactccgtcgagctgctggaaaaccagaaggaaaaacggttctgcaaaatcatgaataaggcccctctggacctgaaagattgcaccatcgagggatggattctgggcaacccaaagtgtgacctgctgctgggcgatcagagctggtcctacattgtggagcggcccaacgctcagaatgggatctgcttcccaggagtcctgaatgaactggaggaactgaaagcattcattggatctggcgagcgagtggaacggttcgagatgtttcccaagagcacatgggcaggagtggatacttcccgcggggtcaccaacgcttgtcctagttacactattgacagctccttttatcgaaatctggtgtggatcgtcaaaaccgattcagccacataccctgtgattaagggaacctataacaatacaggcactcagcccatcctgtacttctggggcgtgcaccatcctctggacaccacagtccaggataacctgtacgggtctggagacaaatatgtgcggatgggaactgagtccatgaactttgcaaagtctcccgaaatcgccgctagacctgccgtgaatggccagaggagtcgcattgattactattggtcagtgctgaggccaggcgaaaccctgaatgtcgagagtaacgggaatctgatcgccccctggtacgcttataaattcgtgtcaaccaacaagaaaggggcagtctttaagagcgacctgccaattgagaattgcgatgccacatgtcagaccatcacaggagtgctgcgcactaacaagaccttccagaatgtctccccactgtggattggcgagtgccccaagtacgtgaaatctgaaagtctgagactggctaccgggctgaggaacgtgccccagatcgcaacacgagggatcttcggagctattgcagggtttatcgagggcgggtggaccggaatgattgacggctggtacgggtatcaccatgagaacagccagggcagcggatatgcagccgaccgagaatccacacagaaggctatcgatggcattactaacaaagtgaacagcatcattaacaagatgaatacacagttcgaggccgtggatcatgagtttagcaacctggaacggagaatcggaaacctgaacaagaggatggaggacggcttcctggacgtgtggacttacaacgctgaactgctggtcctgctggagaatgaaaggaccctggacctgcacgatgcaaacgtgaagaatctgtatgagaaggtcaaaagccagctgcgcgacaacgccaatgatctgggaaacggctgtttcgaattctggcacaagtgcgacaacgagtgtatggagtctgtgaagaatggcacctacgattatcccaagtaccagaaggagagcaagctgaacagacagggaatcgagagcgtgtccgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 141 - protein, 642 aa, Artificial Sequence
  Synthetic
MIAIVVIAILASAGKSDKICIGYHANNSTTQVDTLLEKNVTVTHSVELLENQKEKRFCKIMNKAPLDLKDCTIEGWILGNPKCDLLLGDQSWSYIVERPNAQNGICFPGVLNELEELKAFIGSGERVERFEMFPKSTWAGVDTSRGVTNACPSYTIDSSFYRNLVWIVKTDSATYPVIKGTYNNTGTQPILYFWGVHHPLDTTVQDNLYGSGDKYVRMGTESMNFAKSPEIAARPAVNGQRSRIDYYWSVLRPGETLNVESNGNLIAPWYAYKFVSTNKKGAVFKSDLPIENCDATCQTITGVLRTNKTFQNVSPLWIGECPKYVKSESLRLATGLRNVPQIATRGIFGAIAGFIEGGWTGMIDGWYGYHHENSQGSGYAADRESTQKAIDGITNKVNSIINKMNTQFEAVDHEFSNLERRIGNLNKRMEDGFLDVWTYNAELLVLLENERTLDLHDANVKNLYEKVKSQLRDNANDLGNGCFEFWHKCDNECMESVKNGTYDYPKYQKESKLNRQGIESVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 142 - DNA, 1908 bp, Artificial Sequence
  Synthetic
atgaacacacagatcctggtcttcgcactgattgctattattccaactaacgccgacaagatttgcctgggacatcacgccgtctccaacggcaccaaggtcaataccctgacagagcgaggggtggaagtggtcaacgccactgagacagtggaacgaactaatatcccccggatttgcagcaagggaaaacggaccgtggatctgggccagtgtgggctgctgggaacaatcactggcccccctcagtgcgatcagttcctggagttttccgccgacctgatcattgagcggagagaaggatctgatgtctgtttccctggcaagttcgtgaacgaggaagctctgaggcagatcctgcgagagagcggaggaattgacaaagaagcaatgggcttcacctactccggcatcagaactaatggggccacctcagcttgcaggcgcagcggcagctccttctatgccgagatgaagtggctgctgtccaacacagacaatgccgcttttccccagatgactaagtcttataaaaacaccaggaaaagtcctgcactgatcgtctggggcattcaccattccgtgtctacagccgaacagactaagctgtacgggtctggaaacaaactggtgaccgtcgggtctagtaattatcagcagagcttcgtcccatcccccggagcaaggccacaggtgaacggcctgagcgggcgcatcgactttcactggctgatgctgaaccctaatgacaccgtgacattcagttttaatggcgcattcatcgccccagatagagcctcatttctgaggggcaagtccatggggattcagtctggagtgcaggtcgatgctaactgcgagggcgactgttaccatagtggaggcactatcatttcaaacctgccattccagaatatcgactctagggcagtcggcaagtgtccccgctatgtgaaacagcgaagtctgctgctggccacagggatgaagaatgtgcctgagatcccaaaaggcagagggctgttcggcgctatcgcagggtttattgagaacggatgggaaggcctgattgatgggtggtacggattcaggcaccagaatgcccagggagagggcacagcagccgattataagagtactcagtcagctatcgaccagattaccgggaagctgaaccgcctgatcgaaaaaacaaatcagcagttcgagctgattgataacgagttcaacgaggtcgaaaaacagatcggcaacgtgattaattggaccagagacagcatcacagaggtctggtcctacaacgctgagctgctggtggcaatggaaaatcagcataccattgatctggcagacagcgagatggataagctgtatgaacgagtgaaacggcagctgagagagaacgctgaggaagacgggacaggatgcttcgaaatcttccacaagtgcgacgatgactgtatggccagcatccggaacaatacctacgatcactccaagtatagggaggaggccatgcagaaccgcatccagatcgaccccgtgtctgccgaggaggcagagctggcctacctgctgggcgagctggcctacaagctgggcgagtatcggatcgccatcagggcctaccgcatcgccctgaagagagatcccaacaatgccgaggcctggtacaacctgggcaatgcctactataagcagggccggtatagagaggccatcgagtactatcagaaggccctggagctggaccctaataacgctgaagcttggtataacctgggcaacgcttactatgagaggggcgagtatgaggaagctatcgagtactatcggaaggccctgcggctggaccccaacaatgccgacgccatgcagaacctgctgaatgcaaagatgagggaggag

SEQ ID NO: 143 - protein, 636 aa, Artificial Sequence
  Synthetic
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCFPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 144 - DNA, 1914 bp, Artificial Sequence
  Synthetic
atgaacacacagatcctggtcttcgcactgattgctattattccaactaacgccgacaagatttgcctgggacatcacgccgtctccaacggcaccaaggtcaataccctgacagagcgaggggtggaagtggtcaacgccactgagacagtggaacgaactaatatcccccggatttgcagcaagggaaaacggaccgtggatctgggccagtgtgggctgctgggaacaatcactggcccccctcagtgcgatcagttcctggagttttccgccgacctgatcattgagcggagagaaggatctgatgtctgtttccctggcaagttcgtgaacgaggaagctctgaggcagatcctgcgagagagcggaggaattgacaaagaagcaatgggcttcacctactccggcatcagaactaatggggccacctcagcttgcaggcgcagcggcagctccttctatgccgagatgaagtggctgctgtccaacacagacaatgccgcttttccccagatgactaagtcttataaaaacaccaggaaaagtcctgcactgatcgtctggggcattcaccattccgtgtctacagccgaacagactaagctgtacgggtctggaaacaaactggtgaccgtcgggtctagtaattatcagcagagcttcgtcccatcccccggagcaaggccacaggtgaacggcctgagcgggcgcatcgactttcactggctgatgctgaaccctaatgacaccgtgacattcagttttaatggcgcattcatcgccccagatagagcctcatttctgaggggcaagtccatggggattcagtctggagtgcaggtcgatgctaactgcgagggcgactgttaccatagtggaggcactatcatttcaaacctgccattccagaatatcgactctagggcagtcggcaagtgtccccgctatgtgaaacagcgaagtctgctgctggccacagggatgaagaatgtgcctgagatcccaaaaggcagagggctgttcggcgctatcgcagggtttattgagaacggatgggaaggcctgattgatgggtggtacggattcaggcaccagaatgcccagggagagggcacagcagccgattataagagtactcagtcagctatcgaccagattaccgggaagctgaaccgcctgatcgaaaaaacaaatcagcagttcgagctgattgataacgagttcaacgaggtcgaaaaacagatcggcaacgtgattaattggaccagagacagcatcacagaggtctggtcctacaacgctgagctgctggtggcaatggaaaatcagcataccattgatctggcagacagcgagatggataagctgtatgaacgagtgaaacggcagctgagagagaacgctgaggaagacgggacaggatgcttcgaaatcttccacaagtgcgacgatgactgtatggccagcatccggaacaatacctacgatcactccaagtatagggaggaggccatgcagaaccgcatccagatcgaccccgtgggcggctctgccgaggaggcagagctggcctacctgctgggcgagctggcctacaagctgggcgagtatcggatcgccatcagggcctaccgcatcgccctgaagagagatcccaacaatgccgaggcctggtacaacctgggcaatgcctactataagcagggccggtatagagaggccatcgagtactatcagaaggccctggagctggaccctaataacgctgaagcttggtataacctgggcaacgcttactatgagaggggcgagtatgaggaagctatcgagtactatcggaaggccctgcggctggaccccaacaatgccgacgccatgcagaacctgctgaatgcaaagatgagggaggag

SEQ ID NO: 145 - protein, 638 aa, Artificial Sequence
  Synthetic
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCFPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVGGSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 146 - DNA, 1905 bp, Artificial Sequence
  Synthetic
atggagactatttcactgatgactatcctgctgattactaccgcctcaaacgctgacaagatttgcattgggcaccagagcactaacagcacagagacagtggacacactgaccgagacaaacgtgccagtgacacacgccaaggagctgctgcagaccgagcacaacggcatgctgtgcgccaccaatctgggccacccactgatcctggacacctgcacaatcgagggcctgatctacggcaacccctcctgtgatctgctgctggagggcagggagtggtcctatatcgtggagcgcccatctgccgtgaatggcacatgcttccccggcaacgtggagaatctggaggagctgcgcaccctgttcagctccgcctctagctaccagagaatccagattttccctgacaccacatggaacgtgacctacacaggcacctcccggtcttgtagcggctccttctataggagcatgcgctggctgacacagaagtccggcttttaccccgtgcaggatgccaagtataccaacaatagaggcaagaatatcctgttcgtgtggggcatccaccaccctcacacatacaccgaccagaccacactgtatatcaggaacgataccacaacctctgtgacaaccgaggagctgaatcggatctttaagcccgtgatcgtgcctagactgctggtgaacggccagcagggcaggatcgactactattggagcgtgctgaagccaggacagacactgcgggtgagatccaacggcaatctgatcgccccttggtacggacacgtgctgtctggaggcagccacggacgcatcctgaagaccgatctgaagtccggcaactgcgtggtgcagtgtcagacagagaagggcggcctgaactctaccctgcctttccacaatatcagcaagtacgcctttggcacctgcccaaagtatgtgaaagtgaattctctgaagctggcaatcggcctgcggaacgtgcctgcacggagcaatagaggcctgttcggagcaatcgcaggctttatcgagggaggatggccaggcctggtggcaggctggtatggcttccagcactccaatgaccagggagtgggaatggcagcagacagagattccacacagaaggccgtggataagatcacctctaaggtgaacaatatcgtggacaagatgaacaagcagtacgagatcatcgatcacgagttttctgaggtggagacaaggctgaatatgatcaacaataagatcgacgatcagatccaggacgtgtgggcctataacgccgagctgctggtgctgctggagaatcagaagaccctggacgagcacgatgccaacgtgaacaatctgtacaataaggtgaagcgcgccctgggcagcaacgcaatggaggatggcaagggctgtttcgaactgtaccacaagtgcgacgatcagtgtatggagacaatccggaacggcacatacgaccggagaaagtatcgggaggagagcagactggagaggcagcgcatcgagggcgtgtccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactataggaaggccctgcgcctggaccccaataacgccgatgccatgcagaacctgctgaatgcaaagatgagggaggag

SEQ ID NO: 147 - protein, 635 aa, Artificial Sequence
  Synthetic
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCFPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYDRRKYREESRLERQRIEGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 148 - DNA, 1911 bp, Artificial Sequence
  Synthetic
atgtataaaatcgtcgtcatcattgctctgctgggggctgtgaaggggctggataaaatctgtctggggcaccatgctgtcgctaatggcaccatcgtgaagacactgactaacgagcaggaggaagtgactaatgctaccgagacagtcgaaagcaccggcattaacagactgtgcatgaaaggaaggaagcacaaagacctgggcaattgtcatcctatcggaatgctgattggcactccagcatgcgacctgcacctgacaggcatgtgggatactctgattgagcgcgaaaacgctatcgcatactgtttccccggggccacagtgaatgtcgaggctctgcgacagaagatcatggaatctggcgggatcaacaaaattagtaccgggtttacatacggaagctccattaattccgcaggcaccacacgagcctgcatgcggaacggaggcaattctttttatgcagagctgaagtggcttgtgagtaagtcaaaagggcagaacttccctcagactaccaacacctaccggaatactgacaccgccgagcatctgatcatgtggggcattcaccatccatctagtacacaggagaagaacgatctgtacgggactcagagcctgtccatctctgtgggatcaagcacatatagaaacaatttcgtgccagtggtcggagcccgacctcaggtcaacggacagtctggccggattgactttcactggaccctggtgcagcccggcgataacatcacattcagtcataatgggggactgattgcccctagtcgcgtctcaaagctgattggacgaggcctgggcatccagagcgacgctcctatcgataacaactgcgagtcaaagtgtttttggcggggcgggagcatcaacactagactgccattccagaatctgagtcccaggaccgtggggcagtgtccaaagtacgtcaaccggagatcactgatgctggccaccggaatgagaaatgtgcccgagctgatccagggaaggggcctgtttggcgccattgctgggttcctggagaacgggtgggaaggaatggtggacggctggtacgggtttaggcaccagaatgctcaggggaccggacaggccgctgactataagtccacccaggcagccatcgatcagattacaggcaagctgaaccgcctggtggagaaaacaaatactgagtttgaaagcatcgagtccgaattctctgagatcgaacaccagattggcaacgtgatcaattggaccaaggactctatcactgatatttggacctatcaggctgagctgctggtcgcaatggaaaaccagcatacaatcgacatggccgattccgagatgctgaacctgtatgaaagggtgcgcaagcagctgcggcagaatgctgaggaagacggcaaagggtgcttcgaaatctaccacgcctgcgacgatagctgtatggagtccatccggaacaatacctacgaccactctcagtatagggaggaggccctgctgaaccgcctgaacatcaatcccgtgagcgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 149 - protein, 637 aa, Artificial Sequence
  Synthetic
MYKIVVIIALLGAVKGLDKICLGHHAVANGTIVKTLTNEQEEVTNATETVESTGINRLCMKGRKHKDLGNCHPIGMLIGTPACDLHLTGMWDTLIERENAIAYCFPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 150 - DNA, 1932 bp, Artificial Sequence
  Synthetic
atgaaaactattatcgccctgtcatacatcctgtgcctggtctttgctcagaaaatccctggaaacgacaactccaccgccaccctgtgtctgggccaccacgccgtgccaaatggcaccatcgtgaagaccatcacaaacgaccgcatcgaggtgaccaatgccacagagctggtgcagaacagctccatcggcgagatttgcgacagcccccaccagatcctggatggcgagaactgtacactgatcgacgcactgctgggcgaccctcagtgcgatggcttccagaataagaagtgggatctgtttgtggagcgcagcaaggcctactccaactgtttcccctacgacgtgcctgattatgcctctctgcggagcctggtggcatctagcggcaccctggagttcaagaatgagagctttaattggaccggcgtgacacagaacggcacatcctctgcctgcatccggggcagctcctctagcttcttttcccggctgaactggctgacccacctgaattacacatatcctgccctgaatgtgaccatgccaaacaaggagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccctccagaatctctatctactggaccatcgtgaagccaggcgatatcctgctgatcaactccacaggcaatctgatcgcccccagaggctatttcaagatcaggtccggcaagagctccatcatgaggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaacgtgccagagaagcagaccaggggaatcttcggagcaatcgcaggctttatcgagaatggctgggagggcatggtggacggctggtacggctttagacaccagaactctgagggaaggggacaggcagccgacctgaagagcacccaggccgccatcgatcagatcaacggcaagctgaatagactgatcggcaagacaaatgagaagttccaccagatcgagaaggagtttagcgaggtggagggcagagtgcaggacctggagaagtacgtggaggacaccaagatcgatctgtggtcctataatgccgagctgctggtggccctggagaaccagcacaccatcgacctgacagattctgagatgaacaagctgttcgaaaagaccaagaagcagctgagggagaacgccgaggacatgggcaatggctgcttcaaaatctaccacaagtgcgataacgcctgtatcgagagcatccgcaacgagacatacgaccacaacgtgtacagggatgaggccctgaacaatcgctttcagatcaagggcgtgggcggctccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 151 - protein, 644 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCFPYDVPDYASLRSLVASSGTLEFKNESFNWTGVTQNGTSSACIRGSSSSFFSRLNWLTHLNYTYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIESIRNETYDHNVYRDEALNNRFQIKGVGGSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 152 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 153 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 154 - DNA, 1920 bp, Artificial Sequence
  Synthetic
atgaaagctaagctcctggtgttgttgtgcacgtttacagctacatacgcggacactatatgtatcggctaccacgcgaataactctaccgatacggttgataccgtcctggagaaaaatgtcactgttacacattccgtaaacttgttggaggattctcacaatggaaagctgtgcctcctcaagggcattgcaccgctccaactcggcaactgtagtgttgctggctggatactcggcaacccagagtgtgagttgctcatcagcaaagaaagttggagctacatcgtcgagactcccaatcccgaaaatggaacttgctttccgggatattttgcagactacgaagaactgagggagcagctgtcatctgtctcctcttttgagagatttgagatcttccccaaagaaagttcttggccaaatcacacggtaaccggagtgtcagcgtcatgcagccacaatggtaaatcctccttctacaggaatcttttgtggctcacaggtaagaatggtttgtatccaaatctttcaaaaagctatgtcaacaacaaggaaaaggaagtactcgtcttgtggggagtgcaccaccctcctaacataggcaaccagagagcgctctaccatacggagaatgcatacgtgtcagtggtgtccagtcattactctcggcgattcacccctgaaatcgcaaagcggccaaaggtaagggatcaggaaggcagaataaattactattggactctgctcgagcccggcgacactattatttttgaggcgaatggcaaccttattgcgccttggtatgctttcgcactttcacgcgggtttgggtccggaatcattacctccaacgctcccatggacgaatgcgatgccaagtgccaaactccgcaaggagctatcaatagtagtttgccttttcaaaatgtacatcccgtgacgataggcgaatgtccgaaatacgtaagaagcgcaaagctccggatggtaactggccttagaaacataccctccattcagtcaaggggcctgttcggagccattgccggttttatcgaaggtggttggactggtatggtggatggttggtacggctatcaccaccaaaacgaacaaggaagtggttacgcagccgatcagaagagtactcaaaacgcaattaatggcataaccaacaaggtcaactcagtgatcgagaaaatgaacactcagtttaccgcagttggtaaagaatttaacaagcttgagcggaggatggagaacctcaataaaaaagttgacgacgggttccttgatatctggacctacaacgctgaacttcttgtactgctggagaatgagcgaacactggactttcacgattccaatgtgaaaaacctgtatgaaaaggttaagagtcaactgaagaataatgcgaaggagattgggaacggttgtttcgagttctatcacaaatgtaacaacgaatgcatggagtccgttaagaacgggacatacgactatcccaaatactccgaggaaagcaagcttaacagggagaaaatagacggtgtttctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 155 - protein, 640 aa, Artificial Sequence
  Synthetic
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 156 - DNA, 1920 bp, Artificial Sequence
  Synthetic
atgaaggttaaactgttggtcctcctttgcactttcaccgcgacgtatgccgataccatctgtatcggatatcatgcaaacaattctaccgatacagtcgatacggttcttgagaagaacgtgactgtgacacatagtgtgaatcttcttgaggactcccataacgggaagctttgtctcctcaaaggtatagcacctcttcaactgggcaattgctctgtagccggttggatactgggtaatcctgaatgtgagctcctgatatccagggaaagctggtcatatattgtagagaaacctaatccagaaaatggtacctgtttcccaggacatttcgcggattatgaggaactgcgcgagcagctgtccagtgtcagtagttttgaacgattcgaaatctttccgaaggagagttcatggccaaatcacacgactacaggcgtctcagcgtcctgttcacacaacggtgagagctccttctacaaaaaccttctgtggctgacaggcaaaaatggcctctatccaaatctttctaagagctatgcaaacaacaaggagaaagaagttctggtactctggggggtacatcaccctccaaacattggtgaccaaagagctttgtaccataaggaaaatgcgtacgtctcagtagtgtccagtcactactcacgaaagttcacaccagaaatcgcaaagcgcccgaaagtaagggaccaggaggggcggataaactactactggacactcctggaaccgggcgatacgatcatcttcgaagcaaacggtaatcttatagctccccgatacgctttcgcgctgtccaggggtttcgggagtggtataataaactccaacgcacctatggacgaatgtgatgctaaatgccaaacgccccagggggccattaatagtagtcttccgtttcagaatgttcatcctgtaactatcggggagtgccctaagtacgtacgcagtgctaagctcagaatggtgaccggactccgaaacataccttctattcaatctcggggccttttcggggctatagcgggcttcatagaaggaggctggaccggcatggtcgacgggtggtatgggtaccaccaccagaacgagcaaggctcagggtacgcagcggatcaaaagtctacccagaatgcaattaatggtattactaacaaggtaaacagtgttattgagaaaatgaacactcaatttactgcagtgggtaaagagttcaacaaactcgaacggcgcatggagaatctgaacaaaaaagtggatgacggatttatagacatctggacatataacgcagaactgcttgtccttctcgagaacgaaaggacactcgactttcacgacagcaacgtcaaaaacttgtatgaaaaagtcaaaagtcagttgaagaataatgcgaaagaaatcggaaacggttgtttcgagttctatcacaagtgtaatgatgaatgtatggagtccgtgaagaacgggacttatgactatcctaaatattctgaagagtcaaagcttaatcgggaaaaaatcgacggtgtttctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 157 - protein, 640 aa, Artificial Sequence
  Synthetic
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCFPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 158 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactataaggaaggccggtatagagaggccatcgagtactatcagaaggccctggagctggaccccgataacgctgaagcttggtataacctgggcgatgcttactatgagcggggcgagtatgaggaagctatcgagtactatcggaaggccctgagactggacccaaacaatgccgatgccatgcagaacctgctggaagcaaagatgagggaggag

SEQ ID NO: 159 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRDPDNAEAWYNLGDAYYKEGRYREAIEYYQKALELDPDNAEAWYNLGDAYYERGEYEEAIEYYRKALRLDPNNADAMQNLLEAKMREE

SEQ ID NO: 160 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactatgaagaaggccggtatagagaggccatcgagtactatcaggaagccctggagctggaccccgataacgctgaagcttggtataacctgggcgatgcttactatgagcggggcgagtatgaggaagctatcgagtactatcgggaggccctgagactggacccaaacaatgccgatgccatgcagaacctgctggaagcaaagatgagggaggag

SEQ ID NO: 161 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRDPDNAEAWYNLGDAYYEEGRYREAIEYYQEALELDPDNAEAWYNLGDAYYERGEYEEAIEYYREALRLDPNNADAMQNLLEAKMREE

SEQ ID NO: 162 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcaaatactatcgcaaggccctgaaactggaccccaataacgctgaagcttggtataacctgggcaacgcttactatgagcggggcgagtatgaggaagctatcgagtactatcggaaggccctgagactggacccaaacaatgccgatgccatgcagaacctgctgaaagcaaagatgagggaggag

SEQ ID NO: 163 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRDPNNAEAWYNLGNAYYKQGRYREAIKYYRKALKLDPNNAEAWYNLGNAYYERGEYEEAIEYYRKALRLDPNNADAMQNLLKAKMREE

SEQ ID NO: 164 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccaaaaatgccgaggcctggtacaacctgggcaatgcctactataagcagggccggtatagagaggccatcaaatactatcgcaaggccctgaaactggaccccaagaacgctgaagcttggtataacctgggcaacgcttactatgagcggggcgagtatgaggaagctatcaagtactatcggaaggccctgagactggacccaaacaatgccgatgccatgcagaacctgctgaaagcaaagatgagggaggag

SEQ ID NO: 165 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRDPKNAEAWYNLGNAYYKQGRYREAIKYYRKALKLDPKNAEAWYNLGNAYYERGEYEEAIKYYRKALRLDPNNADAMQNLLKAKMREE

SEQ ID NO: 166 - DNA, 1974 bp, Artificial Sequence
  Synthetic
atgaaagccattattgtcctgctgatggtcgtcacctcaaacgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacatccgcctgtctacacacaacgtgatcaatgccgagaacgccccaggcggcccctataagatcggcacctccggctcttgtcctaatatcacaaacggcaatggcttctttgccaccatggcctgggccgtgccaaagaatgacaagaacaagacagccaccaaccccctgaccatcgaggtgccttacatctgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacagaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcaaccccaaaaatgccgaggcctggtacaacctgggcaatgcctactataagcagggccggtatagaaaagccatcaaatactatcgcaaggccctgaaactgaaccccaagaacgctgaagcttggtataacctgggcaacgcttactatgagcggggcgagtatgagaaggctatcaagtactatcggaaggccctgagactgaatccaaacaatgccgatgccatgcagaacctgctgaaagcaaagatgagggaggag

SEQ ID NO: 167 - protein, 658 aa, Artificial Sequence
  Synthetic
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASAEEAELAYLLGELAYKLGEYRIAIRAYRIALKRNPKNAEAWYNLGNAYYKQGRYRKAIKYYRKALKLNPKNAEAWYNLGNAYYERGEYEKAIKYYRKALRLNPNNADAMQNLLKAKMREE

SEQ ID NO: 168 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactataaggaaggccggtatagagaggccatcgagtactatcagaaggccctggagctggaccccgataacgctgaagcttggtataacctgggcgatgcttactatgagcggggcgagtatgaggaagctatcgagtactatcggaaggccctgagactggacccaaacaatgccgatgccatgcagaacctgctggaagcaaagatgagggaggag

SEQ ID NO: 169 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRDPDNAEAWYNLGDAYYKEGRYREAIEYYQKALELDPDNAEAWYNLGDAYYERGEYEEAIEYYRKALRLDPNNADAMQNLLEAKMREE

SEQ ID NO: 170 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactatgaagaaggccggtatagagaggccatcgagtactatcaggaagccctggagctggaccccgataacgctgaagcttggtataacctgggcgatgcttactatgagcggggcgagtatgaggaagctatcgagtactatcgggaggccctgagactggacccaaacaatgccgatgccatgcagaacctgctggaagcaaagatgagggaggag

SEQ ID NO: 171 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRDPDNAEAWYNLGDAYYEEGRYREAIEYYQEALELDPDNAEAWYNLGDAYYERGEYEEAIEYYREALRLDPNNADAMQNLLEAKMREE

SEQ ID NO: 172 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcaaatactatcgcaaggccctgaaactggaccccaataacgctgaagcttggtataacctgggcaacgcttactatgagcggggcgagtatgaggaagctatcgagtactatcggaaggccctgagactggacccaaacaatgccgatgccatgcagaacctgctgaaagcaaagatgagggaggag

SEQ ID NO: 173 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRDPNNAEAWYNLGNAYYKQGRYREAIKYYRKALKLDPNNAEAWYNLGNAYYERGEYEEAIEYYRKALRLDPNNADAMQNLLKAKMREE

SEQ ID NO: 174 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcgaccccaaaaatgccgaggcctggtacaacctgggcaatgcctactataagcagggccggtatagagaggccatcaaatactatcgcaaggccctgaaactggaccccaagaacgctgaagcttggtataacctgggcaacgcttactatgagcggggcgagtatgaggaagctatcaagtactatcggaaggccctgagactggacccaaacaatgccgatgccatgcagaacctgctgaaagcaaagatgagggaggag

SEQ ID NO: 175 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRDPKNAEAWYNLGNAYYKQGRYREAIKYYRKALKLDPKNAEAWYNLGNAYYERGEYEEAIKYYRKALRLDPNNADAMQNLLKAKMREE

SEQ ID NO: 176 - DNA, 1971 bp, Artificial Sequence
  Synthetic
atgaaagctattatcgtgctgctgatggtcgtgacttccaacgctgacaggatttgcacaggcattacctccagtaactccccacatgtggtgaagacagccacccagggcgaagtgaatgtgaccggcgtgatccctctgaccacaaccccaacaaagtcctacttcgccaatctgaagggcacacggaccagaggcaagctgtgccctgactgtctgaactgcaccgacctggatgtggccctgggcaggcctatgtgcgtgggaacaaccccatccgccaaggcctctatcctgcacgaggtgcgccccgtgacctccggatgctttcctatcatgcacgacaggacaaagatccgccagctgccaaatctgctgcggggctacgagaagatcagactgtctacacagaacgtgatcgatgcagagaaggcaccaggaggaccatatcggctgggcacatccggctcttgtcccaatgccaccagcaagatcggcttctttgccacaatggcctgggccgtgcctaaggacaactacaagaatgccacaaaccccctgaccgtggaggtgccttatatctgcacagagggcgaggaccagatcaccgtgtggggcttccacagcgataacaagacccagatgaagagcctgtacggcgattccaatccccagaagttcacaagctccgccaacggcgtgacaacccactatgtgagccagatcggcgactttccagatcagaccgaggacggaggcctgccacagtccggcaggatcgtggtggattacatgatgcagaagcctggcaagacaggcaccatcgtgtatcagcggggcgtgctgctgccacagaaagtgtggtgtgcctctggccggagcaaagtgatcaagggctctctgccactgatcggcgaggccgactgcctgcacgaggagtatggcggcctgaataagagcaagccctactataccggcaagcacgccaaggccatcggcaattgtccaatctgggtgaagacccccctgaagctggccaacggcacaaagtacaggccacctgcaaagctgctgaaggagaggggcttctttggagcaatcgcaggctttctggagggaggatgggagggaatgatcgcaggatggcacggatatacctcccacggagcacacggagtggcagtggcagccgacctgaagtctacccaggaggccatcaacaagatcacaaagaacctgaatagcctgtccgagctggaggtgaagaatctgcagcggctgtccggcgccatggatgagctgcacaacgagatcctggagctggacgagaaggtggacgatctgagagccgataccatctctagccagatcgagctggccgtgctgctgtctaatgagggcatcatcaacagcgaggatgagcacctgctggccctggagaggaagctgaagaagatgctgggcccttctgccgtggacatcggcaatggctgcttcgaaaccaagcacaagtgcaaccagacatgtctggacagaatcgccgccggcaccttcaatgccggcgagttttctctgcccaccttcgatagcctgaacatcacagcagcctccgccgaggaggcagagctggcctacctgctgggcgagctggcctacaagctgggcgagtataggatcgccatcagggcatacaggatcgccctgaagcgcaaccccaaaaatgccgaggcctggtacaacctgggcaatgcctactataagcagggccggtatagaaaagccatcaaatactatcgcaaggccctgaaactgaaccccaagaacgctgaagcttggtataacctgggcaacgcttactatgagcggggcgagtatgagaaggctatcaagtactatcggaaggccctgagactgaatccaaacaatgccgatgccatgcagaacctgctgaaagcaaagatgagggaggag

SEQ ID NO: 177 - protein, 657 aa, Artificial Sequence
  Synthetic
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASAEEAELAYLLGELAYKLGEYRIAIRAYRIALKRNPKNAEAWYNLGNAYYKQGRYRKAIKYYRKALKLNPKNAEAWYNLGNAYYERGEYEKAIKYYRKALRLNPNNADAMQNLLKAKMREE

SEQ ID NO: 178 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactataaggaaggccggtatagagaggccatcgagtactatcagaaggccctggagctggaccccgataacgctgaagcttggtataacctgggcgatgcttactatgagcggggcgagtatgaggaagctatcgagtactatcggaaggccctgagactggacccaaacaatgccgatgccatgcagaacctgctggaagcaaagatgagggaggag

SEQ ID NO: 179 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRDPDNAEAWYNLGDAYYKEGRYREAIEYYQKALELDPDNAEAWYNLGDAYYERGEYEEAIEYYRKALRLDPNNADAMQNLLEAKMREE

SEQ ID NO: 180 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccgacaatgccgaggcctggtacaacctgggcgacgcctactatgaagaaggccggtatagagaggccatcgagtactatcaggaagccctggagctggaccccgataacgctgaagcttggtataacctgggcgatgcttactatgagcggggcgagtatgaggaagctatcgagtactatcgggaggccctgagactggacccaaacaatgccgatgccatgcagaacctgctggaagcaaagatgagggaggag

SEQ ID NO: 181 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRDPDNAEAWYNLGDAYYEEGRYREAIEYYQEALELDPDNAEAWYNLGDAYYERGEYEEAIEYYREALRLDPNNADAMQNLLEAKMREE

SEQ ID NO: 182 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccaacaatgccgaggcctggtacaacctgggcaatgcctactataagcagggccggtatagagaggccatcaaatactatcgcaaggccctgaaactggaccccaataacgctgaagcttggtataacctgggcaacgcttactatgagcggggcgagtatgaggaagctatcgagtactatcggaaggccctgagactggacccaaacaatgccgatgccatgcagaacctgctgaaagcaaagatgagggaggag

SEQ ID NO: 183 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRDPNNAEAWYNLGNAYYKQGRYREAIKYYRKALKLDPNNAEAWYNLGNAYYERGEYEEAIEYYRKALRLDPNNADAMQNLLKAKMREE

SEQ ID NO: 184 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcgaccccaaaaatgccgaggcctggtacaacctgggcaatgcctactataagcagggccggtatagagaggccatcaaatactatcgcaaggccctgaaactggaccccaagaacgctgaagcttggtataacctgggcaacgcttactatgagcggggcgagtatgaggaagctatcaagtactatcggaaggccctgagactggacccaaacaatgccgatgccatgcagaacctgctgaaagcaaagatgagggaggag

SEQ ID NO: 185 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRDPKNAEAWYNLGNAYYKQGRYREAIKYYRKALKLDPKNAEAWYNLGNAYYERGEYEEAIKYYRKALRLDPNNADAMQNLLKAKMREE

SEQ ID NO: 186 - DNA, 1968 bp, Artificial Sequence
  Synthetic
atgaaagccattattgtcctgctgatggtcgtcacctcaagcgctgatagaatctgcaccggcattacctcctcaaactcccctcacgtggtgaagacagccacccagggcgaggtgaacgtgacaggcgtgatccctctgaccacaaccccaaccaagagccacttcgccaatctgaagggcacagagacaaggggcaagctgtgcccaaagtgtctgaactgcacagacctggatgtggccctgggccgccctaagtgtaccggcaagatcccatccgcccgggtgtctatcctgcacgaggtgcggcccgtgacatccggatgctttcctatcatgcacgaccggaccaagatcagacagctgcccaatctgctgaggggctacgagcacgtgcgcctgtctacacacaacgtgatcaatgccgagggcgccccaggcggcccctataagatcggcacctccggctcttgtcctaatatcacaaacggcaatggcttctttgccaccatggcctgggccgtgccagacaagaacaagacagccaccaaccccctgaccatcgaggtgccttacgtgtgcaccgagggcgaggaccagatcacagtgtggggcttccactccgataatgagacacagatggccaagctgtacggcgattctaagcctcagaagttcaccagctccgccaatggcgtgacaacccactacgtgagccagatcggcggctttccaaaccagaccgaggacggaggcctgccacagtctggacggatcgtggtggattacatggtgcagaagagcggcaagacaggcaccatcacatatcagcggggcatcctgctgccccagaaagtgtggtgtgcctctggccggagcaaagtgatcaagggctctctgcctctgatcggcgaggccgattgcctgcacgagaagtatggcggcctgaacaagagcaagccatactatacaggcgagcacgccaaggccatcggcaattgtccaatctgggtgaagacacccctgaagctggccaacggcaccaagtacaggccacctgcaaagctgctgaaggagaggggcttctttggagcaatcgcaggctttctggagggaggatgggagggaatgatcgcaggatggcacggatataccagccacggagcacacggagtggcagtggcagccgacctgaagtccacacaggaggccatcaacaagatcaccaagaacctgaatagcctgtccgagctggaggtgaagaatctgcagcggctgagcggcgccatggatgagctgcacaacgagatcctggagctggacgagaaggtggacgatctgagagccgataccatctctagccagatcgagctggccgtgctgctgagcaatgagggcatcatcaactccgaggacgagcacctgctggccctggagaggaagctgaagaagatgctgggaccatccgccgtggagatcggaaatggctgcttcgaaaccaagcacaagtgcaaccagacatgtctggacaaaatcgcagcaggcaccttcgatgcaggagagttttctctgcccaccttcgacagcctgaatatcacagcagcctccgccgaggaggcagagctggcctacctgctgggcgagctggcctacaagctgggcgagtataggatcgccatcagggcatacaggatcgccctgaagcgcaaccccaaaaatgccgaggcctggtacaacctgggcaatgcctactataagcagggccggtatagaaaagccatcaaatactatcgcaaggccctgaaactgaaccccaagaacgctgaagcttggtataacctgggcaacgcttactatgagcggggcgagtatgagaaggctatcaagtactatcggaaggccctgagactgaatccaaacaatgccgatgccatgcagaacctgctgaaagcaaagatgagggaggag

SEQ ID NO: 187 - protein, 656 aa, Artificial Sequence
  Synthetic
MKAIIVLLMVVTSSADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEGAPGGPYKIGTSGSCPNITNGNGFFATMAWAVPDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASAEEAELAYLLGELAYKLGEYRIAIRAYRIALKRNPKNAEAWYNLGNAYYKQGRYRKAIKYYRKALKLNPKNAEAWYNLGNAYYERGEYEKAIKYYRKALRLNPNNADAMQNLLKAKMREE

SEQ ID NO: 188 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagagagaagatcgacggcgtgtctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 189 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 190 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagagagaagatcgacggagtgaaggcagaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 191 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGVKAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 192 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagggagaagatcgacggcgtgcgcgcagaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 193 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGVRAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 194 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagagagaagatcgacggcttttctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 195 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGFSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 196 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagagagaagatcgacggctttaaggcagaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 197 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGFKAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 198 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattccaccgacacagtggatacagtgctggagaagaacgtgaccgtgacacactccgtgaatctgggctctggcctgcggctggccaccggcctgagaaacgtgcccagcatccagtccaggggcctgttcggagcaatcgcaggctttatcgagggaggctggacaggcatggtggatggctggtacggctatcaccaccagaacgagcagggcagcggatatgcagcagacctgaagtccacccagaatgccatcgataagatcacaaacatggtgaattctgtgatcgagaagatgggctctggaggcagcggaacctacaacgcagagctgctggtgctgctgctgaatgagcggacactggactatcacgatagcaacgtgaagaatctgtatgaaaaagtgagaaaccagctgaagaataacgccaaagaaatcggcaacggatgcttcgaattctaccacaagtgcgacaacacctgtatggagagcgtgaagaatggcacatacgattatcccaagtactccgaggaggccaagctgaacagggagaagatcgacggctttcgcgcagaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 199 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGFRAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 200 - DNA, 1053 bp, Artificial Sequence
  Synthetic
atggatagtaaggggtcctcacagaaggggtctcggctgctgctgctgctggtcgtgtcaaatctgctgctgcctcagggcgtgctagccgacaccctgtgcatcggctaccacgccaacaattctaccgacacagtggatacagtgctggagaagaacgtgaccgtgacacactctgtgaatctgggcagcggcctgaggctggccaccggcctgcgcaacgtgccccagcgggagacaagaggcctgttcggagcaatcgcaggctttatcgagggaggatggaccggaatggtggatggatggtacggctatcaccaccagaacgagcagggctccggatacgcagccgacctgaagtctacccagaatgccatcgataagatcacaaacatggtgaatagcgtgatcgagaagatgggcagcggaggctccggaacctataacgcagagctgctggtgctgctgctgaatgagcggacactggactaccacgattccaacgtgaagaatctgtatgagaaggtgaggaaccagctgaagaacaatgccaaggagatcggcaatggctgtttcgaattctaccacaagtgcgacaacacctgtatggagagcgtgaagaatggcacatacgattatcccaagtactccgaggaggccaagctgaacagagagaagatcgacggcgtgtctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 201 - protein, 351 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPQRETRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 202 - DNA, 1053 bp, Artificial Sequence
  Synthetic
atggacagtaaggggtcttcacagaaagggtcacggctgctgctgctgctggtcgtcagtaacctgctgctgcctcagggagtgctagccgataccatctgcatcggctaccacgcaaataactctactgacaccgtcgacactgtgctggagaagaatgtgactgtgacccactcagtgaacctgggcagcggcctgaggatggtgaccggcctgcgcaatatcccaagcatccagtcccggggcctgttcggagcaatcgcaggctttatcgagggaggatggacaggaatggtggacggatggtacggctatcaccaccagaacgagcagggcagcggctacgcagcagatcagaagtccacccagaacgccatcaatggcatcacaaacatggtgaattccgtgatcgagaagatgggctctggcggcagcggcaccgacctggcagagctgctggtgctgctgctgaacgagaggacactggacttccacgattctaacgtgaagaatctgtacgagaaggtgaagagccagctgaagaacaatgccaaggagatcggcaatggctgcttcgaattctaccacaagtgcaacaatgagtgtatggagtccgtgaagaacggcacctacgactatcccaagtattccgaggagtctaagctgaatcgcgagaagatcgatggcgtgtctgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggaaacgcctactatgagagaggcgagtatgaggaagctatcgagtactatcggaaggccctgagactggacccaaacaatgccgatgccatgcagaacctgctgaatgccaagatgcgggaagaa

SEQ ID NO: 203 - protein, 351 aa, Artificial Sequence
  Synthetic
MDSKGSSQKGSRLLLLLVVSNLLLPQGVLADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 204 - DNA, 1053 bp, Artificial Sequence
  Synthetic
atggacagtaaggggtcttcacagaaagggtcacggctgctgctgctgctggtcgtcagtaacctgctgctgcctcagggagtgctagccgacaccatctgcatcggataccacgccaataactcaactgacaccgtcgacaccgtcctggagaaaaatgtgactgtgactcatagcgtgaacctgggctccggcctgcggatggtgaccggcctgagaaatatcccctctcagagggagacaggcctgttcggagcaatcgcaggctttatcgagggaggatggaccggaatggtggacggctggtacggctatcaccaccagaacgagcagggctctggctacgccgccgatcagaagagcacccagaacgccatcaatggcatcacaaacatggtgaatagcgtgatcgagaagatgggcagcggaggctccggaaccgacctggcagagctgctggtgctgctgctgaatgagcggacactggacttccacgattccaacgtgaagaatctgtatgagaaagtgaaatcccagctgaaaaataacgctaaggaaatcggcaacgggtgtttcgaattctaccacaagtgcaacaatgagtgtatggagtccgtgaagaacggcacctacgactatcccaagtattccgaggagtctaagctgaatcgcgagaagatcgatggcgtgtctgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggaaacgcctactatgagagaggcgagtatgaggaagctatcgagtactatcggaaggccctgagactggacccaaacaatgccgatgccatgcagaacctgctgaatgccaagatgcgggaagaa

SEQ ID NO: 205 - protein, 351 aa, Artificial Sequence
  Synthetic
MDSKGSSQKGSRLLLLLVVSNLLLPQGVLADTICIGYHANNSTDTVDTVLEKNVTVTHSVNLGSGLRMVTGLRNIPSQRETGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 206 - DNA, 1053 bp, Artificial Sequence
  Synthetic
atggacagtaaggggtcatcacagaaagggtcacggctgctgctgctgctggtcgtctcaaatctgctgctgccacagggagtgctagccgacaccatctgcatcggctaccacgccaacaattctaccgacacagtggatacagtgctggagaagaacgtgaccgtgacacacagcgtgaatctgggctccggactgaggatggtgaccggactgcgcaacatcccaagcatccagtcccggggactgttcggagcaatcgcaggctttatcgagggaggctggacaggcatgatcgacggctggtacggctatcaccaccagaatgagcagggctctggctacgccgccgatcagaagagcacccagaacgccatcaatggcatcacaaacatggtgaattccgtgatcgagaagatgggctctggaggcagcggaacctacaacgcagagctgctggtgctgctgctgaatgagcggacactggacttccacgattccaacgtgaagaatctgtatgagaaggtgaagtctcagctgaagaacaatgccaaggagatcggcaacggctgtttcgagttttaccacaagtgcaacaatgagtgtatggagagcgtgaagaacggcacctacgactatcccaagtattccgaggagtctaagctgaatagagagaagatcgatggcgtgtccgccgaggaggcagagctggcctacctgctgggcgagctggcctacaagctgggcgagtatcggatcgccatcagggcctatcgcatcgccctgaagagagaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 207 - protein, 351 aa, Artificial Sequence
  Synthetic
MDSKGSSQKGSRLLLLLVVSNLLLPQGVLADTICIGYHANNSTDTVDTVLEKNVTVTHSVNLGSGLRMVTGLRNIPSIQSRGLFGAIAGFIEGGWTGMIDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 208 - DNA, 1053 bp, Artificial Sequence
  Synthetic
atggacagtaaggggtcatcacagaaagggtcacggctgctgctgctgctggtcgtctcaaatctgctgctgccacagggagtgctagccgacaccatctgcatcggctaccacgccaacaattctaccgacacagtggatacagtgctggagaagaacgtgaccgtgacacacagcgtgaatctgggctccggactgaggatggcaaccggactgcgcaacatcccaagcatccagtcccggggactgttcggagcaatcgcaggctttatcgagggaggctggacaggcatgatcgatggctggtacggctatcaccaccagaacgagcagggctctggatacgcagcagaccagaagagcacccagaatgccatcgatggcatcacaaacatggtgaattccgtgatcgagaagatgggctctggaggcagcggaacctacaacgcagagctgctggtgctgctgctgaatgagcggacactggacttccacgattccaacgtgagaaatctgtatgagaaggtgaagtctcagctgaagaacaatgccaaggagatcggcaacggctgtttcgagttttaccacaagtgcgacgatgcctgtatggagagcgtgcggaacggcacctacgactatcccaagtattccgaggagtctaagctgaatagagaggagatcgatggcgtgtccgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 209 - protein, 351 aa, Artificial Sequence
  Synthetic
MDSKGSSQKGSRLLLLLVVSNLLLPQGVLADTICIGYHANNSTDTVDTVLEKNVTVTHSVNLGSGLRMATGLRNIPSIQSRGLFGAIAGFIEGGWTGMIDGWYGYHHQNEQGSGYAADQKSTQNAIDGITNMVNSVIEKMGSGGSGTYNAELLVLLLNERTLDFHDSNVRNLYEKVKSQLKNNAKEIGNGCFEFYHKCDDACMESVRNGTYDYPKYSEESKLNREEIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 210 - DNA, 1053 bp, Artificial Sequence
  Synthetic
atggacagtaaggggtcttcacagaaagggtcacggctgctgctgctgctggtcgtcagtaacctgctgctgcctcagggagtgctagccgatcagatttgtattgggtatcacgctaacaactcaaccgaaaaggtggacactatcctggaaagaaatgtgaccgtcactcacgccaaggacatcggctctggcctggtgctggccaccggcctgcggaacgtgccccagatcgagagcagaggcctgttcggagcaatcgcaggctttatcgagggaggatggcagggaatggtggacggctggtacggctatcaccactctaatgaccagggcagcggctacgccgccgataaggagagcacccagaaggccttcgatggcatcacaaacatggtgaattccgtgatcgagaagatgggcagcggcggctccggcacctacaacgccgagctgctggtgctgatgctgaatgagcggacactggactttcacgattccaacgtgaagaatctgtacgacaaggtgcggatgcagctgagagataacgtgaaggagctgggcaatggctgcttcgaattctaccacaagtgcgacgatgagtgtatgaactctgtgaagaatggcacatacgattatcccaagtatgaggaggagtccaagctgaacagaaatgagatcaagggcgtgtctgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggaaacgcctactatgagcggggcgagtatgaggaagctatcgagtactataggaaggccctgcgcctggacccaaacaatgccgatgccatgcagaacctgctgaacgctaagatgcgggaagaa

SEQ ID NO: 211 - protein, 351 aa, Artificial Sequence
  Synthetic
MDSKGSSQKGSRLLLLLVVSNLLLPQGVLADQICIGYHANNSTEKVDTILERNVTVTHAKDIGSGLVLATGLRNVPQIESRGLFGAIAGFIEGGWQGMVDGWYGYHHSNDQGSGYAADKESTQKAFDGITNMVNSVIEKMGSGGSGTYNAELLVLMLNERTLDFHDSNVKNLYDKVRMQLRDNVKELGNGCFEFYHKCDDECMNSVKNGTYDYPKYEEESKLNRNEIKGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 212 - DNA, 1065 bp, Artificial Sequence
  Synthetic
atggattcaaaggggtcatcacagaaaggaagtagactgctgctgctgctggtcgtgtcaaacctgctgctgcctcagggcgtgctagccgacaagctgtgcctgggccaccacgcagtgccaaacggcaccatcgtgaagaccatcacaaacgatcggatcgaggtgaccaatgccacagagctggtgttcccaggatgtggcgtgctgaagctggccaccggcatgaggaatgtgcctgagaagcagacaaggggaatcttcggagcaatcgcaggctttatcgagaacggctgggagggcatggtggacggctggtacggctttcggcaccagaatagcgagggaagaggacaggccgccgacctgaagtccacacaggcagccatcgatcagatcaacggcatggtgaatagagtgatcgagctgatggagcagggcggccccgattgctatctggccgagctgctggtggccctgctgaaccagcacgtgatcgacctgaccgattctgagatgaataagctgttcgagaagacaaagaagcagctgagggagaacgccgaggacatgggcaatggctgcttcaaaatctaccacaagtgcgataacgcctgtatcggcagcatccgcaacggcacatacgaccacaacgtgtacagggatgaggccctgaacaatcgctttcagatcaagggcgtgtccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggaccccaataacgccgatgccatgcagaacctgctgaatgccaagatgagagaggag

SEQ ID NO: 213 - protein, 355 aa, Artificial Sequence
  Synthetic
MDSKGSSQKGSRLLLLLVVSNLLLPQGVLADKLCLGHHAVPNGTIVKTITNDRIEVTNATELVFPGCGVLKLATGMRNVPEKQTRGIFGAIAGFIENGWEGMVDGWYGFRHQNSEGRGQAADLKSTQAAIDQINGMVNRVIELMEQGGPDCYLAELLVALLNQHVIDLTDSEMNKLFEKTKKQLRENAEDMGNGCFKIYHKCDNACIGSIRNGTYDHNVYRDEALNNRFQIKGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 214 - DNA, 1065 bp, Artificial Sequence
  Synthetic
atggattcaaaggggtcatcacagaaaggaagtagactgctgctgctgctggtcgtgtcaaacctgctgctgcctcagggcgtgctagccgacaagctgtgcctgggccaccacgcagtgccaaacggcaccatcgtgaagaccatcacaaacgatcggatcgaggtgaccaatgccacagagctggtgttcccaggatgtggcgtgctgaagctggccaccggcatgaggaatgtgcctgagaagcagacaaggggaatcttcggagcaatcgcaggctttatcgagaacggctgggagggcatggtggacggctggtacggctttcggcaccagaatagcgagggaagaggacaggccgccgacctgaagtccacacaggcagccatcgatcagatcaacggcatggtgaatagagtgatcgagctgatggagcagggcggccccgattgctatctggccgagctgctggtggccctgctgaaccagcacgtgatcgacctgaccgattctgagatgaataagctgttcgagaagacaaagaagcagctgagagagaacgctgaggaagacgggacaggatgcttcgaaatcttccacaagtgcgacgatgactgtatggccagcatccggaacaatacctacgatcactccaagtatagggaggaggccatgcagaaccgcatccagatcgaccccgtgtctgccgaggaggcagagctggcctacctgctgggcgagctggcctacaagctgggcgagtatcggatcgccatcagggcctaccgcatcgccctgaagagagatcccaacaatgccgaggcctggtacaacctgggcaatgcctactataagcagggccggtatagagaggccatcgagtactatcagaaggccctggagctggaccctaataacgctgaagcttggtataacctgggcaacgcttactatgagaggggcgagtatgaggaagctatcgagtactatcggaaggccctgcggctggaccccaacaatgccgacgccatgcagaacctgctgaatgcaaagatgagggaggag

SEQ ID NO: 215 - protein, 355 aa, Artificial Sequence
  Synthetic
MDSKGSSQKGSRLLLLLVVSNLLLPQGVLADKLCLGHHAVPNGTIVKTITNDRIEVTNATELVFPGCGVLKLATGMRNVPEKQTRGIFGAIAGFIENGWEGMVDGWYGFRHQNSEGRGQAADLKSTQAAIDQINGMVNRVIELMEQGGPDCYLAELLVALLNQHVIDLTDSEMNKLFEKTKKQLRENAEEDGTGCFEIFHKCDDDCMASIRNNTYDHSKYREEAMQNRIQIDPVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 216 - DNA, 1053 bp, Artificial Sequence
  Synthetic
atggacagtaaggggtcttcacagaaagggtcacggctgctgctgctgctggtcgtcagtaacctgctgctgcctcagggagtgctagccgatcagatttgtatcgggtatcacgccaataacagcacagaacaggtcgacactatcatggagaagaatgtcaccgtcactcacgcacaggacatcggcagcggcctggtgctggccaccggcctgcggaactccccacagagggagtctcgcggcctgttcggagcaatcgcaggctttatcgagggaggatggcagggaatggtggacggctggtacggctatcaccacagcaatgagcagggctccggctacgcagcagacaaggagtccacccagaaggccatcgatggcgtgacaaacatggtgaattctatcatcgataagatgggcagcggcggctccggcacctacaacgccgagctgctggtgctgatgctgaatgagaggacactggacttccacgattccaacgtgaagaatctgtacgacaaggtgcggctgcagctgagagataacgccaaggagctgggcaatggctgcttcgaattctaccacaagtgcgataacgagtgtatggagtctatccgcaacggcacatacaattatccccagtatagcgaggaggcccggctgaagagagaggagatctctggcgtgagcgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggaaacgcctactatgagaggggcgagtatgaggaagctatcgagtactataggaaggccctgcgcctggacccaaacaatgccgatgccatgcagaatctgctgaatgccaaaatgagagaagaa

SEQ ID NO: 217 - protein, 351 aa, Artificial Sequence
  Synthetic
MDSKGSSQKGSRLLLLLVVSNLLLPQGVLADQICIGYHANNSTEQVDTIMEKNVTVTHAQDIGSGLVLATGLRNSPQRESRGLFGAIAGFIEGGWQGMVDGWYGYHHSNEQGSGYAADKESTQKAIDGVTNMVNSIIDKMGSGGSGTYNAELLVLMLNERTLDFHDSNVKNLYDKVRLQLRDNAKELGNGCFEFYHKCDNECMESIRNGTYNYPQYSEEARLKREEISGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 218 - DNA, 1053 bp, Artificial Sequence
  Synthetic
atggacagtaaggggtcatcacagaaagggtcacggctgctgctgctgctggtcgtctcaaatctgctgctgccacagggagtgctagccgacaagatctgcatcggctaccacgccaacaatagcaccacacaggtggataccctgctggagaagaacgtgaccgtgacacactctgtggagctgggcagcggcctgcggctggccaccggcctgagaaatgtgccccagatcgccacaaggggcatcttcggagcaatcgcaggctttatcgagggaggctggacaggcatgatcgacggctggtacggctatcaccacgagaacagccagggctccggatacgcagcagacagggagtccacccagaaggccatcgatggcatcacaaacatggtgaattccatcatcaacaagatgaataccggcggctctggcacatataacgccgagctgctggtgctgctgctgaatgagcggaccctggacctgcacgatgccaacgtgaagaatctgtatgagaaagtgaaaagtcagctgcgagacaacgctaacgacctgggcaatgggtgcttcgaattctggcacaagtgcgacaacgagtgtatggagtctgtgaagaatggcacctacgattatcccaagtaccagaaggagagcaagctgaacagacagggaatcgagagcgtgtccgccgaggaggcagagctggcctacctgctgggcgagctggcctacaagctgggcgagtataggatcgccatcagggcctatcgcatcgccctgaagcgcgaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagcggggcgagtatgaggaagctatcgagtactatcggaaggccctgagactggacccaaacaatgccgatgccatgcagaacctgctgaatgcaaagatgagggaggag

SEQ ID NO: 219 - protein, 351 aa, Artificial Sequence
  Synthetic
MDSKGSSQKGSRLLLLLVVSNLLLPQGVLADKICIGYHANNSTTQVDTLLEKNVTVTHSVELGSGLRLATGLRNVPQIATRGIFGAIAGFIEGGWTGMIDGWYGYHHENSQGSGYAADRESTQKAIDGITNMVNSIINKMNTGGSGTYNAELLVLLLNERTLDLHDANVKNLYEKVKSQLRDNANDLGNGCFEFWHKCDNECMESVKNGTYDYPKYQKESKLNRQGIESVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 220 - DNA, 1068 bp, Artificial Sequence
  Synthetic
atggattcaaaggggtcatcacagaaaggaagtagactgctgctgctgctggtcgtgtcaaacctgctgctgcctcagggcgtgctagccgacaagatctgcctgggccaccacgccgtgtctaacggcaccaaagtgaataccctgacagagaggggagtggaggtggtgaacgcaaccgagctggtgttcccaggctgtggcgtgctgaagctggccacaggcatgaagaatgtgcccgagatccctaagggaaggggactgttcggagcaatcgcaggctttatcgagaacggctgggagggcctgatcgatggctggtacggctttcgccaccagaatgcacagggagagggaaccgccgccgactataagagcacacagtccgccatcgatcagatcacaggcatggtgaacagagtgatcgagctgatggagcagggaggaccagactgctacctggccgagctgctggtggccatgctgaatcagcacgtgatcgacctggccgatagcgagatggataagctgtatgagcgggtgaagagacagctgagagagaacgctgaggaagacgggacaggatgcttcgaaatcttccacaagtgcgacgatgactgtatggccagcatccggaacaatacctacgatcactccaagtatagggaggaggccatgcagaaccgcatccagatcgaccccgtgtctgccgaggaggcagagctggcctacctgctgggcgagctggcctacaagctgggcgagtatcggatcgccatcagggcctaccgcatcgccctgaagagagatcccaacaatgccgaggcctggtacaacctgggcaatgcctactataagcagggccggtatagagaggccatcgagtactatcagaaggccctggagctggaccctaataacgctgaagcttggtataacctgggcaacgcttactatgagaggggcgagtatgaggaagctatcgagtactatcggaaggccctgcggctggaccccaacaatgccgacgccatgcagaacctgctgaatgcaaagatgagggaggag

SEQ ID NO: 221 - protein, 356 aa, Artificial Sequence
  Synthetic
MDSKGSSQKGSRLLLLLVVSNLLLPQGVLADKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIELMEQGGPDCYLAELLVAMLNQHVIDLADSEMDKLYERVKRQLRENAEEDGTGCFEIFHKCDDDCMASIRNNTYDHSKYREEAMQNRIQIDPVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 222 - DNA, 1053 bp, Artificial Sequence
  Synthetic
atggattcaaaggggtcatcacagaaaggaagtagactgctgctgctgctggtcgtgtcaaacctgctgctgcctcagggcgtgctagccgacaagatctgcatcggccaccagagcacaaactccaccgagacagtggataccctgacagagacaaatgtgccagtgacccacgcaaaggagctgggctccggcctgaagctggccatcggcctgaggaacgtgccagcacggtctaatagaggcctgttcggagcaatcgcaggctttatcgagggaggatggcctggcctggtggcaggatggtacggattccagcacagcaacgaccagggagtgggaatggcagcagaccgggattctacacagaaggccgtggacaagatcaccagcatggtgaacaatatcgtggataagatgaacaagggcggctccggcgcctataatgccgagctgctggtgctgctgctgaaccagaagacactggacgagcacgatgccaatgtgaacaatctgtataacaaggtcaaaagagcactggggtcaaacgcaatggaggatgggaaggggtgtttcgaactgtaccacaagtgcgacgatcagtgtatggagacaatccggaacggcacatacgaccggagaaagtatcgggaggagagcagactggagaggcagcgcatcgagggcgtgtccgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactataggaaggccctgcgcctggaccccaataacgccgatgccatgcagaacctgctgaatgcaaagatgagggaggag

SEQ ID NO: 223 - protein, 351 aa, Artificial Sequence
  Synthetic
MDSKGSSQKGSRLLLLLVVSNLLLPQGVLADKICIGHQSTNSTETVDTLTETNVPVTHAKELGSGLKLAIGLRNVPARSNRGLFGAIAGFIEGGWPGLVAGWYGFQHSNDQGVGMAADRDSTQKAVDKITSMVNNIVDKMNKGGSGAYNAELLVLLLNQKTLDEHDANVNNLYNKVKRALGSNAMEDGKGCFELYHKCDDQCMETIRNGTYDRRKYREESRLERQRIEGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 224 - DNA, 1071 bp, Artificial Sequence
  Synthetic
atggattcaaaggggtcatcacagaaaggaagtagactgctgctgctgctggtcgtgtcaaacctgctgctgcctcagggcgtgctagccctggacaagatctgcctgggccaccacgcagtggcaaacggcaccatcgtgaagaccctgacaaacgagcaggaggaggtgaccaatgccacagagctggtgttcccaggatgtggcgtgctgatgctggccacaggcatgaggaatgtgcctgagctgatccagggaaggggactgttcggagcaatcgcaggctttctggagaacggctgggagggcatggtggacggctggtacggctttcggcaccagaatgcacagggaaccggacaggccgccgactataagagcacccaggccgccatcgatcagatcacaggcatggtgaacagggtggtggagctgatggagcagggaggaccagattgctacctggccgagctgctggtggccatgctgaaccagcacgtgatcgacatggccgattccgagatgcggaatctgtatgagcgggtgagaaagcagctgcggcagaatgctgaggaagacggcaaagggtgcttcgaaatctaccacgcctgcgacgatagctgtatggagtccatccggaacaatacctacgaccactctcagtatagggaggaggccctgctgaaccgcctgaacatcaatcccgtgagcgccgaggaggcagagctggcctacctgctgggcgagctggcctacaagctgggcgagtatcggatcgccatcagggcctatcgcatcgccctgaagcgggaccccaacaatgccgaggcctggtacaacctgggcaatgcctactataagcagggccggtatagagaggccatcgagtactatcagaaggccctggagctggaccccaataacgctgaagcttggtataacctgggcaacgcttactatgagaggggcgagtatgaggaagctatcgagtactatcggaaggccctgagactggacccaaacaatgccgatgccatgcagaacctgctgaatgcaaagatgagggaggag

SEQ ID NO: 225 - protein, 357 aa, Artificial Sequence
  Synthetic
MDSKGSSQKGSRLLLLLVVSNLLLPQGVLALDKICLGHHAVANGTIVKTLTNEQEEVTNATELVFPGCGVLMLATGMRNVPELIQGRGLFGAIAGFLENGWEGMVDGWYGFRHQNAQGTGQAADYKSTQAAIDQITGMVNRVVELMEQGGPDCYLAELLVAMLNQHVIDMADSEMRNLYERVRKQLRQNAEEDGKGCFEIYHACDDSCMESIRNNTYDHSQYREEALLNRLNINPVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 226 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattaacggcatgatgaatgtgcagctgaacacgggcgtgccagtgttaagtgccgtgctgaccccacacaactatgataaaagcaaagcccataccctgctgttcttagcgctgtttgcggtgaaaggcatggaagcggcgcgtgcctgcgtggagattttagcggcccgtgaaaagattgcggcgggttct

SEQ ID NO: 227 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVINGMMNVQLNTGVPVLSAVLTPHNYDKSKAHTLLFLALFAVKGMEAARACVEILAAREKIAAGS

SEQ ID NO: 228 - DNA, 477 bp, Artificial Sequence
  Synthetic
atgaaccagcatagccataaagattatgaaaccgtgcgtatcgcggttgttcgtgcgcgttggcatgcggagatcgttgatgcgtgtgttagtgcctttgaggccgcgatggccgacattggcggcgaccgttttgcggtggatgtgttcgatgtgccaggcgcgtatgaaattccgctgcatgcgcgtaccctggcggaaaccggccgttatggcgcggttttaggcaccgcctttgtggtgaacggcggcatttaccgccatgaatttgtggcgagtgcggttattgatggcatgatgaatgtgcagctgagtacgggcgtgccagtgctgagtgccgttctgaccccgcatcgttatcgtgatagcgatgcgcacacgctgctgtttctggcgttatttgccgtgaaaggcatggaagcggcgcgtgcctgtgtggagattttagccgcgcgtgagaaaattgcggccggttct

SEQ ID NO: 229 - protein, 159 aa, Artificial Sequence
  Synthetic
MNQHSHKDYETVRIAVVRARWHAEIVDACVSAFEAAMADIGGDRFAVDVFDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAAGS

SEQ ID NO: 230 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacaccgttatcgtgatagcgatgcccataccctgctgttcttagcgctgtttgcggtgaaaggcatggaagcggcgcgtgcctgcgtggagattttagcggcccgtgaaaagattgcggcgggttct

SEQ ID NO: 231 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHRYRDSDAHTLLFLALFAVKGMEAARACVEILAAREKIAAGS

SEQ ID NO: 232 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacacgaatatgaagatagcgatgcccataccctgctgttcttagcgctgtttgcggtgaaaggcatggaagcggcgcgtgcctgcgtggagattttagcggcccgtgaaaagattgcggcgggttct

SEQ ID NO: 233 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHEYEDSDAHTLLFLALFAVKGMEAARACVEILAAREKIAAGS

SEQ ID NO: 234 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtggatggtggcatttatgatcacgaatttgtggcgagcgcggttattgatggcatgatgaatgtgcagctggatacgggcgtgccagtgttaagtgccgtgctgaccccacacgaatatgaagatagcgatgccgataccctgctgttcttagcgctgtttgcggtgaaaggcatggaagcggcgcgtgcctgcgtggagattttagcggcccgtgaaaagattgcggcgggttct

SEQ ID NO: 235 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVDGGIYDHEFVASAVIDGMMNVQLDTGVPVLSAVLTPHEYEDSDADTLLFLALFAVKGMEAARACVEILAAREKIAAGS

SEQ ID NO: 236 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacaccattataagaaaagcaaagccaaaaccctgctgttcttagcgctgtttgcggtgaaaggcatggaagcggcgcgtgcctgcgtggagattttagcggcccgtgaaaagattgcggcgggttct

SEQ ID NO: 237 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHHYKKSKAKTLLFLALFAVKGMEAARACVEILAAREKIAAGS

SEQ ID NO: 238 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacacaactatgatgatagcgatgcccataccctgctgttcttagcgctgtttgcggtgaaaggcatggaagcggcgcgtgcctgcgtggagattttagcggcccgtgaaaagattgcggcgggttct

SEQ ID NO: 239 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDDSDAHTLLFLALFAVKGMEAARACVEILAAREKIAAGS

SEQ ID NO: 240 - DNA, 477 bp, Artificial Sequence
  Synthetic
atgaaccagcacagtcacaaggaccacgaaacggtaagaatagcggtagtgcgtgcgcgttggcatgcggaaattgtggacgcctgtgtgagtgcgtttgaagccgcgatgcgtgatattggcggcgatcgttttgccgtggatgtgtttgatgtgccgggtgcgtacgaaattccactgcatgcgcgtaccctggcggaaaccggccgttatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacacaactatgataaaagcaaagcccataccctgctgttcttagcgctgtttgcggtgaaaggcatggaagcggcgcgtgcctgcgtggagattttagcggcccgtgaaaagattgcggcgggttct

SEQ ID NO: 241 - protein, 159 aa, Artificial Sequence
  Synthetic
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHNYDKSKAHTLLFLALFAVKGMEAARACVEILAAREKIAAGS

SEQ ID NO: 242 - DNA, 477 bp, Artificial Sequence
  Synthetic
atgaaccagcacagtcaraaggaccargaaacggtaagaatagcggtagtgcgtgcgcgctggcatgcgtttattgtggacgcctgtgtgagtgcgtttgaagccgcgatgcgtaaaattggcggcgaacgttttgccgtggatgtgtttgatgtgccgggtgcgtacgaaattccactgcatgcgcgtaccctggcgaaaaccggccgctatggcgcggtgttaggcaccgcctttgtggtgaatggtggcatttatcgtcacgaatttgtggcgagcgcggttattgatggcatgatgaatgtgcagctggatacgggcgtgccagtgttaagtgccgtgctgaccccacacaactacgacaagagcaacgccaaaaccctgctgttcttagcgctgtttgcggtgaaaggcatggaagcggcgcgtgcctgcgtggagattttagcggcccgtgaaaagattgcggcgggttct

SEQ ID NO: 243 - protein, 159 aa, Artificial Sequence
  Synthetic
MNQHSQKDQETVRIAVVRARWHAFIVDACVSAFEAAMRKIGGERFAVDVFDVPGAYEIPLHARTLAKTGRYGAVLGTAFVVNGGIYRHEFVASAVIDGMMNVQLDTGVPVLSAVLTPHNYDKSNAKTLLFLALFAVKGMEAARACVEILAAREKIAAGS

SEQ ID NO: 244 - DNA, 642 bp, Artificial Sequence
  Synthetic
tccgccgccaaggccgaggaggccgccaggaagatggaggagctgtttaagaagcacaagatcgtggccgtgctgcgcgccaactctgtggaggaggccatcgagaaggcagtggccgtgttcgcaggaggagtgcacctgatcgagatcacctttacagtgccagacgccgatacagtgatcaaggccctgtccgtgctgaaggagaagggagcaatcatcggagcaggaaccgtgacatctgtggagcagtgcaggaaggccgtggagtctggcgccgagttcatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccacagtttgtgaaggccatgaagggccccttccctaatgtgaagtttgtgcccaccggcggcgtgaacctggacaacgtgtgcgagtggttcaaggcaggcgtgctggccgtgggagtgggcgatgccctggtgaagggcgaccctgatgaggtgcgggagaaggccaagaagtttgtggagaagattagaggctgtaccgaa

SEQ ID NO: 245 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCEWFKAGVLAVGVGDALVKGDPDEVREKAKKFVEKIRGCTE

SEQ ID NO: 246 - DNA, 642 bp, Artificial Sequence
  Synthetic
tccgccgccaaggccgaggaggccgccaggaagatggaggagctgtttaagaagcacaagatcgtggccgtgctgcgcgccaactctgtggaggaggccatcgagaaggcagtggccgtgttcgcaggaggagtgcacctgatcgagatcacctttacagtgccagacgccgatacagtgatcaaggccctgtccgtgctgaaggagaagggagcaatcatcggagcaggaaccgtgacatctgtggagcagtgcaggaaggccgtggagtctggcgccgagttcatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccagagtttgtggaggccatgaagggccccttccctaatgtgaagtttgtgccaaccggaggagtggacctggacgacgtgtgcgagtggttcgatgcaggcgtgctggccgtgggagtgggcgacgccctggtggagggcgaccctgatgaggtgcgggaggatgccaaggagtttgtggaggagattagaggatgtaccgaa

SEQ ID NO: 247 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPEFVEAMKGPFPNVKFVPTGGVDLDDVCEWFDAGVLAVGVGDALVEGDPDEVREDAKEFVEEIRGCTE

SEQ ID NO: 248 - DNA, 642 bp, Artificial Sequence
  Synthetic
tccgccgccaaggccgaggaggccgccaggaagatggaagagctgtttaagaagcataaaatcgtggccgtgctgcgcgccaatagtgtggaggaagccattgaaaaagccgttgcggtttttgcgggtggtgtgcatctgattgaaattacctttaccgtgccggatgcggataccgtgattaaagcgctgagcgttctgaaagagaaaggcgcgattattggtgcgggcaccgtgacgagcgtggagcagtgccgtaaagcggtggagagcggtgcggaatttatcgtgagcccgcatctggatgaagaaattagccagttctgcaaagaaaaaggcgtgttctatatgccgggtgttatgaccccgaccgagctggtgaaagccatgaaactgggccataccatcttaaaactgtttccgggcgaagtggtgggtccgcagtttgtgaaggcgatgaaaggcccatttccgaatgtgaaatttgtgccgaccggtggcgtgaatttagataatgtgtgcgagtggtttaaggcgggtgtgctggcggtgggcgtgggcagcgccctggttaagggcaccccggatgaggtgcgtgagaaagcgaaggcgtttgtggagaaaatccgtggctgcaccgaa

SEQ ID NO: 249 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 250 - DNA, 642 bp, Artificial Sequence
  Synthetic
tccgccgccaaggccgaggaggccgccaggaagatggaggagctattcaagaagcacaaaatagtggcagtgctgagggcgaatagcgtggaggaagcgattgagaaggccgtggccgtgttcgccggtggcgttcatctgattgaaattacctttaccgtgccggatgcggataccgtgattaaggcgctgagtgtgttaaaagagaaaggcgcgattattggtgcgggcaccgttaccagtgtggagcagtgccgtaaagcggtggaaagtggcgccgaatttatcgttagcccgcatctggatgaagaaattagccagttctgcaaagaaaaaggcgtgttctatatgccaggcgttatgaccccaacggaactggttaaagcgatgaagctgggccatgatatcctgaagttatttccaggtgaagtggttggtccggaatttgtgaaagccatgaagggcccgttcccgaatgtgaagttcgtgccaaccggcggtgttgatctggataatgtgtgcgagtggtttgatgccggcgtgctggcggtgggcgtgggcgatgccttagttgaaggcgatccggacgaggtgcgtgaaaaagcgaaagaatttgttgaaaagatccgtggctgcaccgaa

SEQ ID NO: 251 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPEFVKAMKGPFPNVKFVPTGGVDLDNVCEWFDAGVLAVGVGDALVEGDPDEVREKAKEFVEKIRGCTE

SEQ ID NO: 252 - DNA, 642 bp, Artificial Sequence
  Synthetic
tccgccgccaaggccgaggaggccgccaggaagatggaggagctattcaagaagcacaaaatagtggcagtgctgagggcgaatagcgtggaggaagcgattgagaaggccgtggccgtgttcgccggtggcgttcatctgattgaaattacctttaccgtgccggatgcggataccgtgattaaggcgctgagtgtgttaaaagagaaaggcgcgattattggtgcgggcaccgttaccagtgtggagcagtgccgtaaagcggtggaaagtggcgccgaatttatcgttagcccgcatctggatgaagaaattagccagttctgcaaagaaaaaggcgtgttctatatgccaggcgttatgaccccaacggaactggttaaagcgatgaagctgggccatgatatcctgaagttatttccaggtgaagtggttggtccgcaatttgtgaaagccatgaagggcccgttcccgaatgtgaagttcgtgccaaccggcggtgttaacctggataatgtgtgcaaatggtttaaagccggcgtgctggcggtgggcgtgggcaaagccttagttaagggcaaaccggacgaggtgcgtgaaaaagcgaaaaagtttgttaaaaagatccgtggctgcaccgaa

SEQ ID NO: 253 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCKWFKAGVLAVGVGKALVKGKPDEVREKAKKFVKKIRGCTE

SEQ ID NO: 254 - DNA, 642 bp, Artificial Sequence
  Synthetic
tccgccgccaaggccgaggaggccgccaggaagatggaggagctattcaagaagcacaaaatagtggcagtgctgagggcgaatagcgtggaggaagcgattgagaaggccgtggccgtgttcgccggtggcgttcatctgattgaaattacctttaccgtgccggatgcggataccgtgattaaggcgctgagtgtgttaaaagagaaaggcgcgattattggtgcgggcaccgttaccagtgtggagcagtgccgtaaagcggtggaaagtggcgccgaatttatcgttagcccgcatctggatgaagaaattagccagttctgcaaagaaaaaggcgtgttctatatgccaggcgttatgaccccaacggaactggttaaagcgatgaagctgggccatgatatcctgaagttatttccaggtgaagtggttggtccgaaatttgtgaaagccatgaagggcccgttcccgaatgtgaagttcgtgccaaccggcggtgttaacctgaaaaatgtgtgcaaatggtttaaagccggcgtgctggcggtgggcgtgggcaaagccttagttaagggcaaaccggacaaagtgcgtgaaaaagcgaaaaagtttgttaaaaagatccgtggctgcaccgaa

SEQ ID NO: 255 - protein, 214 aa, Artificial Sequence
  Synthetic
SAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPKFVKAMKGPFPNVKFVPTGGVNLKNVCKWFKAGVLAVGVGKALVKGKPDKVREKAKKFVKKIRGCTE

SEQ ID NO: 256 - DNA, 642 bp, Artificial Sequence
  Synthetic
tccgccgccaaggccgaggaggccgccaggaagacggaggagctattcaagcgccacacgatagtggcagtgctgagggcgaatagcgtggaggaagcgattgagaaggccgtggccgtgttcgccggtggcgttcatctgattgaaattacctttaccgtgccggatgcggataccgtgattaaggcgctgagtgtgttaaaagaggatggcgcgattattggtgcgggcaccgttaccagtgtggatcagtgccgtaaagcggtggaaagtggcgccgaatttatcgttagcccgcatctggatgaagaaattagccagttctgcaaggaaaaaggcgtgttctatatgccaggcgttatgaccccaacggaactggttaaagcgatgaagctgggccatgatatcctgaagttatttccaggtgaagtggttggtccgcagtttgtgaaagccatgaagggcccgttcccgaatgtgaagttcgtgccaaccggcggtgttaacctggataatgtgtgcaaatggtttaaagccggcgtgctggcggtgggcgtgggcaacgccttagttaagggcaacccggacaaagtgcgtgaaaaagcgaaaaagtttgttaagaagatccgtggctgcaccgaa

SEQ ID NO: 257 - protein, 217 aa, Artificial Sequence
  Synthetic
SAAKAEEAARKTEELFKRHTIVAVLRANSVEEAIEKAVAVFAGGVHLIEITFTVPDADTVIKALSVLKEDGAIIGAGTVTSVDQCRKAVESGANTTEFIVSPHLDEEISQFCKEKGVFYMPGVMTPTELVKAMKLGHDILKLFPGEVVGPQFVKAMKGPFPNVKFVPTGGVNLDNVCKWFKAGVLAVGVGNALVKGNPDKVREKAKKFVKKIRGCTE

SEQ ID NO: 258 - DNA, 2208 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattctatcacaagtgcgacaatacctgcatggagagcgtcaaaaacgggacctacgattacccaaaatacagcgaggaagccaaactgaacagggagggaggcagcggaggcagcggctccgccgccaaggcagaggaggcagcaaggaagatggaggagctgttcaagaagcacaagatcgtggccgtgctgagagccaattccgtggaggaggccatcgagaaggcagtggccgtgttcgcaggaggagtgcacctgatcgagatcacctttacagtgccagacgccgataccgtgatcaaggccctgtccgtgctgaaggagaagggagcaatcatcggagcaggaaccgtgacatctgtggagcagtgcaggaaggcagtggagtctggagccgagtttatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccacagtttgtgaaggccatgaagggccccttccctaacgtgaagtttgtgcccacaggcggcgtgaacctggacaacgtgtgcgagtggttcaaggcaggcgtgctggcagtgggagtgggcgatgccctggtgaagggcgaccctgatgaggtgcgggagaaggccaagaagtttgtggaaaagattagaggatgtactgaa

SEQ ID NO: 259 - protein, 736 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREGGSGGSGSAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCEWFKAGVLAVGVGDALVKGDPDEVREKAKKFVEKIRGCTE

SEQ ID NO: 260 - DNA, 2208 bp, Artificial Sequence
  Synthetic
atgaaggcaatcctggtcgtcctgctgtacactttcactactgctaacgctgacactctgtgcatcgggtatcacgccaacaactccaccgacacagtggataccgtgctggagaagaacgtgaccgtgacacactctgtgaacctgctggaggacaagcacaatggcaagctgtgcaagctgaggggagtggcaccactgcacctgggcaagtgcaacatcgccggctggattctgggcaatcctgagtgtgagtctctgagcaccgccagctcctggtcctacatcgtggagacaagcaactctgacaatggcacatgctttcccggcgatttcatcaactatgaggagctgcgggagcagctgtctagcgtgtccagcttcgagcggttcgagattttcccaaagaccagctcctggcccaaccacgactccaataagggagtgacagcagcatgtcctcacgcaggcgccaagtctttttacaagaacctgatctggctggtgaagaagggcaattcttacccaaagctgaaccagagctatatcaatgataagggcaaggaggtgctggtgctgtggggcatccaccacccttccaccacagccgaccagcagtctctgtaccagaacgccgatgcctacgtgttcgtgggcaccagccggtactccaagaagttcaagcctgagatcgccacacggccaaaggtgcgggaccaggagggcagaatgaattactattggaccctggtggagcctggcgataagatcacctttgaggccacaggcaacctggtggtgccacggtatgccttcaccatggagagaaatgccggctccggcatcatcatctctgacacaccagtgcacgattgcaacaccacatgtcagacccccgagggcgccatcaacacaagcctgcccttccagaatatccaccctatcaccatcggcaagtgcccaaagtacgtgaagtccaccaagctgaggctggccacaggcctgcgcaatgtgccctctatccagagcaggggcctgtttggagcaatcgcaggcttcatcgagggaggatggacaggaatggtggacggatggtacggctatcaccaccagaacgagcagggcagcggatatgcagccgacctgaagtccacccagaatgccatcgataagatcacaaacaaggtcaatagcgtgatcgagaagatgaacacccagtttacagccgtgggcaaggagttcaatcacctggagaagcgcatcgagaacctgaataagaaggtggacgatggctttctggatatctggacctacaacgccgagctgctggtgctgctggagaatgagaggacactggactaccacgattccaacgtgaagaatctgtatgagaaggtgcgcaaccagctgaagaacaatgccaaggagatcggcaatggctgtttcgaattttaccacaaatgcgacaatacctgcatggaaagcgtcaagaacgggacttacgattaccccaaatactcagaagaagccaaactgaacagggagggaggcagcggaggcagcggctccgccgccaaggcagaggaggcagcaaggaagatggaggagctgttcaagaagcacaagatcgtggccgtgctgagagccaattccgtggaggaggccatcgagaaggcagtggccgtgttcgcaggaggagtgcacctgatcgagatcacctttacagtgccagacgccgataccgtgatcaaggccctgtccgtgctgaaggagaagggagcaatcatcggagcaggaaccgtgacatctgtggagcagtgcaggaaggcagtggagtctggagccgagtttatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccagagtttgtggaggccatgaagggccccttccctaacgtgaagtttgtgccaacaggaggagtggacctggacgacgtgtgcgagtggttcgatgcaggcgtgctggcagtgggagtgggcgacgccctggtggagggcgaccctgatgaggtgcgggaggatgccaaggagtttgtggaggagattagaggatgtactgag

SEQ ID NO: 261 - protein, 736 aa, Artificial Sequence
  Synthetic
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCFPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREGGSGGSGSAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPEFVEAMKGPFPNVKFVPTGGVDLDDVCEWFDAGVLAVGVGDALVEGDPDEVREDAKEFVEEIRGCTE

SEQ ID NO: 262 - DNA, 2214 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaaaacaaagaaacagctgagagagaacgccgaggatatgggaaatggatgcttcaaaatctaccacaaatgcgacaatgcctgtattggcagcatccggaacggcacctacgaccacaacgtgtaccgggatgaggccctgaacaatagattccagggaggctccggaggcagcggctccgccgccaaggccgaggaggccgccaggaagatggaggagctgtttaagaagcacaagatcgtggccgtgctgcgcgccaactctgtggaggaggccatcgagaaggcagtggccgtgttcgcaggaggagtgcacctgatcgagatcacctttacagtgccagacgccgatacagtgatcaaggccctgtccgtgctgaaggagaagggagcaatcatcggagcaggaaccgtgacatctgtggagcagtgcaggaaggccgtggagtctggcgccgagttcatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccacagtttgtgaaggccatgaagggccccttccctaatgtgaagtttgtgcccaccggcggcgtgaacctggacaacgtgtgcgagtggttcaaggcaggcgtgctggccgtgggagtgggcgatgccctggtgaagggcgaccctgatgaggtgcgggagaaggccaagaagtttgtggagaagattagaggctgtaccgaa

SEQ ID NO: 263 - protein, 738 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQGGSGGSGSAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCEWFKAGVLAVGVGDALVKGDPDEVREKAKKFVEKIRGCTE

SEQ ID NO: 264 - DNA, 2214 bp, Artificial Sequence
  Synthetic
atgaagactattattgccctgtcctacatcctgtgcctggtgtttgctcagaaaatccctgggaacgacaactccactgctaccctgtgtctgggccaccacgccgtgccaaatggcaccatcgtgaagaccatcacaaacgacagaatcgaggtgaccaatgccacagagctggtgcagaacagctccatcggcgagatttgcgacagcccccaccagatcctggatggcgagaactgtaccctgatcgacgcactgctgggcgaccctcagtgcgatggcttccagaataagaagtgggatctgtttgtggagcgcagcaaggcctactccaactgttacccctatgacgtgcctgattatgcctctctgcggagcctggtggcatctagcggcaccctggagttcaacaatgagagctttaattggaccggcgtgacacagaacggcacatcctctgcctgcatccggagaagctcctctagcttcttttccaggctgaactggctgacccacctgaattacacatatcctgccctgaatgtgaccatgccaaacaatgagcagttcgataagctgtacatctggggagtgcaccacccaggaacagacaaggatcagattttcctgtatgcccagtcctctggccgcatcaccgtgtctacaaagcggagccagcaggccgtgatccctaacatcggctctaggccacgcatccgggacatcccatcccgcatctctatctactggaccatcgtgaagccaggcgatatcctgctgatcaactccacaggcaatctgatcgcccccagaggctatttcaagatcaggtccggcaagagctccatcatgcggtctgacgcccccatcggcaagtgcaagagcgagtgtatcacccctaacggctccatcccaaatgataagccctttcagaacgtgaatcgcatcacatacggcgcctgtcctcggtacgtgaagcacagcaccctgaagctggccacaggcatgagaaatgtgccagagaagcagaccaggggaatcttcggagcaatcgcaggctttatcgagaatggctgggagggcatggtggacggctggtacggcttcagacaccagaactctgagggaaggggacaggcagccgacctgaagagcacccaggccgccatcgatcagatcaacggcaagctgaatagactgatcggcaagacaaacgagaagttccaccagatcgagaaggagtttagcgaggtggagggcagaatccaggacctggagaagtacgtggaggacaccaagatcgatctgtggtcctataatgccgagctgctggtggccctggagaaccagcacaccatcgacctgacagattctgagatgaataagctgttcgaaaaaaccaaaaaacagctgagagaaaacgcagaggacatggggaacgggtgcttcaaaatctatcataagtgtgacaacgcttgcattggcagcatccggaacggcacctacgaccacaacgtgtaccgggatgaggccctgaacaatagattccagggaggctccggaggcagcggctccgccgccaaggccgaggaggccgccaggaagatggaggagctgtttaagaagcacaagatcgtggccgtgctgcgcgccaactctgtggaggaggccatcgagaaggcagtggccgtgttcgcaggaggagtgcacctgatcgagatcacctttacagtgccagacgccgatacagtgatcaaggccctgtccgtgctgaaggagaagggagcaatcatcggagcaggaaccgtgacatctgtggagcagtgcaggaaggccgtggagtctggcgccgagttcatcgtgagcccccacctggacgaggagatcagccagttctgtaaggagaagggcgtgttttacatgccaggcgtgatgacccccacagagctggtgaaggccatgaagctgggccacgatatcctgaagctgttccctggcgaggtggtgggcccagagtttgtggaggccatgaagggccccttccctaatgtgaagtttgtgccaaccggaggagtggacctggacgacgtgtgcgagtggttcgatgcaggcgtgctggccgtgggagtgggcgacgccctggtggagggcgaccctgatgaggtgcgggaggatgccaaggagtttgtggaggagattagaggatgtaccgaa

SEQ ID NO: 265 - protein, 738 aa, Artificial Sequence
  Synthetic
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQGGSGGSGSAAKAEEAARKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPEFVEAMKGPFPNVKFVPTGGVDLDDVCEWFDAGVLAVGVGDALVEGDPDEVREDAKEFVEEIRGCTE

SEQ ID NO: 266 - protein, 207 aa, Artificial sequence
  Synthetic
  MISC_FEATURE (1)..(1): Optional
MEGMDPLAVLAESRLLPLLTVRGGEDLAGLATVLELMGVGALEITLRTEKGLEALKALRKSGLLLGAGTVRSPKEAEAALEAGAAFLVSPGLLEEVAALAQARGVPYLPGVLTPTEVERALALGLSALKFFPAEPFQGVRVLRAYAEVFPEVRFLPTGGIKEEHLPHYAALPNLLAVGGSWLLQGDLAAVMKKVKAAKALLSPQAPG

SEQ ID NO: 267 - protein, 156 aa, Artificial sequence
  Synthetic
  MISC_FEATURE (1)..(1): Optional
MTKKVGIVDTTFARVDMAEAAIRTLKALSPNIKIIRKTVPGIKDLPVACKKLLEEEGCDIVMALGMPGKAEKDKVCAHEASLGLMLAQLMTNKHIIEVFVHEDEAKDDDELDILALVRAIEHAANVYYLLFKPEYLTRMAGKGLRQGREDAGPARE

SEQ ID NO: 268 - protein, 156 aa, Artificial sequence
  Synthetic
  MISC_FEATURE (1)..(1): Optional
MTKKVGIVDTTFARVDMASAAILTLKMESPNIKIIRKTVPGIKDLPVACKKLLEEEGCDIVMALGMPGKAEKDKVCAHEASLGLMLAQLMTNKHIIEVFVHEDEAKDDAELKILAARRAIEHALNVYYLLFKPEYLTRMAGKGLRQGFEDAGPARE

SEQ ID NO: 269 - protein, 209 aa, Artificial sequence
  Synthetic
  MISC_FEATURE (1)..(1): Optional
MSTINNQLKALKVIPVIAIDNAEDIIPLGKVLAENGLPAAEITFRSSAAVKAIMLLRSAQPEMLIGAGTILNGVQALAAKEAGATFVVSPGFNPNTVRACQIIGIDIVPGVNNPSTVEAALEMGLTTLKFFPAEASGGISMVKSLVGPYGDIRLMPTGGITPSNIDNYLAIPQVLACGGTWMVDKKLVTNGEWDEIARLTREIVEQVNP

SEQ ID NO: 270 - protein, 114 aa, Artificial sequence
  Synthetic
  MISC_FEATURE (1)..(1): Optional
MPIFTLNTNIKATDVPSDFLSLTSRLVGLILSKPGSYVAVHINTDQQLSFGGSTNPAAFGTLMSIGGIEPSKNRDHSAVLFDHLNAMLGIPKNRMYIHFVNLNGDDVGWNGTTF

SEQ ID NO: 271 - protein, 157 aa, Artificial sequence
  Synthetic
  MISC_FEATURE (1)..(1): Optional
MNQHSHKDYETVRIAVVRARWHADIVDACVEAFEIAMAAIGGDRFAVDVFDVPGAYEIPLHARTLAETGRYGAVLGTAFVVNGGIYRHEFVASAVIDGMMNVQLSTGVPVLSAVLTPHRYRDSAEHHRFFAAHFAVKGVEAARACIEILAAREKIAA

SEQ ID NO: 272 - protein, 205 aa, Artificial sequence
  Synthetic
  MISC_FEATURE (1)..(1): Optional
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 273 - protein, 157 aa, Artificial sequence
  Synthetic
  MISC_FEATURE (1)..(1): Optional
MNQHSHKDYETVRIAVVRARWHAEIVDACVSAFEAAMADIGGDRFAVDVFDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAA

SEQ ID NO: 274 - protein, 177 aa, Artificial sequence
  Synthetic
  MISC_FEATURE (1)..(1): Optional
MFTKSGDDGNTNVINKRVGKDSPLVNFLGDLDELNSFIGFAISKIPWEDMKKDLERVQVELFEIGEDLSTQSSKKKIDESYVLWLLAATAIYRIESGPVKLFVIPGGSEEASVLHVTRSVARRVERNAVKYTKELPEINRMIIVYLNRLSSLLFAMALVANKRRNQSEKIYEIGKSW

SEQ ID NO: 275 - protein, 157 aa, Artificial sequence
  Synthetic
  MISC_FEATURE (1)..(1): Optional
MNQHSHKDYETVRIAVVRARWHADIVDQCVRAFEEAMADAGGDRFAVDVFDVPGAYEIPLHARTLAETGRYGAVLGTAFVVNGGIYRHEFVASAVIDGMMNVQLSTGVPVLSAVLTPHRYRSSREHHEFFREHFMVKGVEAAAACITILAAREKIAA

SEQ ID NO: 276 - protein, 201 aa, Artificial sequence
  Synthetic
  MISC_FEATURE (1)..(1): Optional
MGHTKGPTPQQHDGSALRIGIVHARWNKTIIMPLLIGTIAKLLECGVKASNIVVQSVPGSWELPIAVQRLYSASQLQTPSSGPSLSAGDLLGSSTTDLTALPTTTASSTGPFDALIAIGVLIKGETMHFEYIADSVSHGLMRVQLDTGVPVIFGVLTVLTDDQAKARAGVIEGSHNHGEDWGLAAVEMGVRRRDWAAGKTE

SEQ ID NO: 277 - protein, 237 aa, Artificial sequence
  Synthetic
  MISC_FEATURE (1)..(1): Optional
MYEVDHADVYDLFYLGRGKDYAAEASDIADLVRSRTPEASSLLDVACGTGTHLEHFTKEFGDTAGLELSEDMLTHARKRLPDATLHQGDMRDFQLGRKFSAVVSMFSSVGYLKTVAELGAAVASFAEHLEPGGVVVVEPWWFPETFADGWVSADVVRRDGRTVARVSHSVREGNATRMEVHFTVADPGKGVRHFSDVHLITLFHQREYEAAFMAAGLRVEYLEGGPSGRGLFVGVPA

SEQ ID NO: 278 - protein, 138 aa, Artificial sequence
  Synthetic
  MISC_FEATURE (1)..(1): Optional
MGMKEKFVLIITHGDFGKGLLSGAEVIIGKQENVHTVGLNLGDNIEKVAKEVMRIIIAKLAEDKEIIIVVDLFGGSPFNIALEMMKTFDVKVITGINMPMLVELLTSINVYDTTELLENISKIGKDGIKVIEKSSLKM

SEQ ID NO: 279 - protein, 154 aa, Artificial sequence
  Synthetic
  MISC_FEATURE (1)..(1): Optional
MKYDGSKLRIGILHARWNLEIIAALVAGAIKRLQEFGVKAENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFN

SEQ ID NO: 280 - protein, 164 aa, Artificial sequence
  Synthetic
  MISC_FEATURE (1)..(1): Optional
MAVKGLGEVDQKYDGSKLRIGILHARWNRKIILALVAGAVLRLLEFGVKAENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFN

SEQ ID NO: 281 - protein, 175 aa, Artificial sequence
  Synthetic
  MISC_FEATURE (1)..(1): Optional
MGANWYLDNESSRLSFTSTKNADIAEVHRFLVLHGKVDPKGLAEVEVETESISTGIPLRDMLLRVLVFQVSKFPVAQINAQLDMRPINNLAPGAQLELRLPLTVSLRGKSHSYNAELLATRLDERRFQVVTLEPLVIHAQDFDMVRAFNALRLVAGLSAVSLSVPVGAVLIFTAR

SEQ ID NO: 282 - protein, 208 aa, Artificial sequence
  Synthetic
  MISC_FEATURE (1)..(1): Optional
MTDYIRDGSAIKALSFAIILAEADLRHIPQDLQRLAVRVIHACGMVDVANDLAFSEGAGKAGRNALLAGAPILCDARMVAEGITRSRLPADNRVIYTLSDPSVPELAKKIGNTRSAAALDLWLPHIEGSIVAIGNAPTALFRLFELLDAGAPKPALIIGMPVGFVGAAESKDELAANSRGVPYVIVRGRRGGSAMTAAAVNALASERE

SEQ ID NO: 283 - protein, 128 aa, Artificial sequence
  Synthetic
  MISC_FEATURE (1)..(1): Optional
MITVFGLKSKLAPRREKLAEVIYSSLHLGLDIPKGKHAIRFLCLEKEDFYYPFDRSDDYTVIEINLMAGRSEETKMLLIFLLFIALERKLGIRAHDVEITIKEQPAHCWGFRGRTGDSARDLDYDIYV

SEQ ID NO: 284 - protein, 235 aa, Artificial sequence
  Synthetic
  MISC_FEATURE (1)..(1): Optional
MGSDLQKLQRFSTCDISDGLLNVYNIPTGGYFPNLTAISPPQNSSIVGTAYTVLFAPIDDPRPAVNYIDSVPPNSILVLALEPHLQSQFHPFIKITQAMYGGLMSTRAQYLKSNGTVVFGRIRDVDEHRTLNHPVFAYGVGSCAPKAVVKAVGTNVQLKILTSDGVTQTICPGDYIAGDNNGIVRIPVQETDISKLVTYIEKSIEVDRLVSEAIKNGLPAKAAQTARRMVLKDYI

SEQ ID NO: 285 - protein, 162 aa, Artificial sequence
  Synthetic
  MISC_FEATURE (1)..(1): Optional
MSGMRVYLGADHAGYELKQAIIAFLKMTGHEPIDCGALRYDADDDYPAFCIAAATRTVADPGSLGIVLGGSGNGEQIAANKVPGARCALAWSVQTAALAREHNNAQLIGIGGRMHTLEEALRIVKAFVTTPWSKAQRHQRRIDILAEYERTHEAPPVPGAPA

SEQ ID NO: 286 - protein, 157 aa, Artificial sequence
  Synthetic
  MISC_FEATURE (1)..(1): Optional
MGDDARIAAIGDVDELNSQIGVLLAEPLPDDVRAALSAIQHDLFDLGGELCIPGHAAITEDHLLRLALWLVHYNGQLPPLEEFILPGGARGAALAHVCRTVCRRAERSIKALGASEPLNIAPAAYVNLLSDLLFVLARVLNRAAGGADVLWDRTRAH

SEQ ID NO: 287 - protein, 157 aa, Artificial sequence
  Synthetic
  MISC_FEATURE (1)..(1): Optional
MILSAEQSFTLRHPHGQAAALAFVREPAAALAGVQRLRGLDSDGEQVWGELLVRVPLLGEVDLPFRSEIVRTPQGAELRPLTLTGERAWVAVSGQATAAEGGEMAFAFQFQAHLATPEAEGEGGAAFEVMVQAAAGVTLLLVAMALPQGLAAGLPPA

SEQ ID NO: 288 - protein, 156 aa, Artificial sequence
  Synthetic
  MISC_FEATURE (1)..(1): Optional
MTKKVGIVDTTFARVDMASAAILTLKMESPNIKIIRKTVPGIKDLPVACKKLLEEEGCDIVMALGMPGKKEKDKVCAHEASLGLMLAQLMTNKHIIEVFVHEDEAKDDAELKILAARRAIEHALNVYYLLFKPEYLTRMAGKGLRQGFEDAGPARE

SEQ ID NO: 289 - protein, 209 aa, Artificial sequence
  Synthetic
  MISC_FEATURE (1)..(1): Optional
MDDINNQLKRLKVIPVIAIDNAEDIIPLGKVLAENGLPAAEITFRSSAAVKAIMLLRSAQPEMLIGAGTILNGVQALAAKEAGADFVVSPGFNPNTVRACQIIGIDIVPGVNNPSTVEQALEMGLTTLKFFPAEASGGISMVKSLVGPYGDIRLMPTGGITPDNIDNYLAIPQVLACGGTWMVDKKLVRNGEWDEIARLTREIVEQVNP

SEQ ID NO: 290 - protein, 114 aa, Artificial sequence
  Synthetic
  MISC_FEATURE (1)..(1): Optional
MPIFTLNTNIKADDVPSDFLSLTSRLVGLILSKPGSYVAVHINTDQQLSFGGSTNPAAFGTLMSIGGIEPDKNRDHSAVLFDHLNAMLGIPKNRMYIHFVNLNGDDVGWNGTTF

SEQ ID NO: 291 - protein, 157 aa, Artificial sequence
  Synthetic
  MISC_FEATURE (1)..(1): Optional
MNQHSHKDHETVRIAVVRARWHADIVDACVEAFEIAMAAIGGDRFAVDVFDVPGAYEIPLHARTLAETGRYGAVLGTAFVVNGGIYRHEFVASAVIDGMMNVQLDTGVPVLSAVLTPHRYRDSDEHHRFFAAHFAVKGVEAARACIEILNAREKIAA

SEQ ID NO: 292 - protein, 114 aa, Artificial sequence
  Synthetic
  MISC_FEATURE (1)..(1): Optional
MPIFTLNTNIKADDVPSDFLSLTSRLVGLILSEPGSYVAVHINTDQQLSFGGSTNPAAFGTLMSIGGIEPDKNEDHSAVLFDHLNAMLGIPKNRMYIHFVDLDGDDVGWNGTTF

SEQ ID NO: 293 - protein, 157 aa, Artificial sequence
  Synthetic
  MISC_FEATURE (1)..(1): Optional
MNQHSHKDHETVRIAVVRARWHADIVDACVEAFEIAMAAIGGDRFAVDVFDVPGAYEIPLHARTLAETGRYGAVLGTAFVVDGGIYDHEFVASAVIDGMMNVQLDTGVPVLSAVLTPHEYEDSDEDHEFFAAHFAVKGVEAARACIEILNAREKIAA

SEQ ID NO: 294 - protein, 205 aa, Artificial sequence
  Synthetic
  MISC_FEATURE (1)..(1): Optional
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCEWFKAGVLAVGVGDALVKGDPDEVREKAKKFVEKIRGCTE

SEQ ID NO: 295 - protein, 157 aa, Artificial sequence
  Synthetic
  MISC_FEATURE (1)..(1): Optional
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVIDGMMNVQLDTGVPVLSAVLTPHRYRDSDAHTLLFLALFAVKGMEAARACVEILAAREKIAA

SEQ ID NO: 296 - protein, 205 aa, Artificial sequence
  Synthetic
  MISC_FEATURE (1)..(1): Optional
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPEFVEAMKGPFPNVKFVPTGGVDLDDVCEWFDAGVLAVGVGDALVEGDPDEVREDAKEFVEEIRGCTE

SEQ ID NO: 297 - protein, 157 aa, Artificial sequence
  Synthetic
  MISC_FEATURE (1)..(1): Optional
MNQHSHKDHETVRIAVVRARWHAEIVDACVSAFEAAMRDIGGDRFAVDVFDVPGAYEIPLHARTLAETGRYGAVLGTAFVVDGGIYDHEFVASAVIDGMMNVQLDTGVPVLSAVLTPHEYEDSDADTLLFLALFAVKGMEAARACVEILAAREKIAA

SEQ ID NO: 298 - protein, 205 aa, Artificial sequence
  Synthetic
  MISC_FEATURE (1)..(1): Optional
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHDILKLFPGEVVGPQFVKAMKGPFPNVKFVPTGGVNLDNVCKWFKAGVLAVGVGKALVKGKPDEVREKAKKFVKKIRGCTE

SEQ ID NO: 299 - protein, 157 aa, Artificial sequence
  Synthetic
  MISC_FEATURE (1)..(1): Optional
MNQHSHKDHETVRIAVVRARWHAEIVDACVSAFEAAMRDIGGDRFAVDVFDVPGAYEIPLHARTLAETGRYGAVLGTAFVVNGGIYRHEFVASAVINGMMNVQLNTGVPVLSAVLTPHNYDKSKAHTLLFLALFAVKGMEAARACVEILAAREKIAA

SEQ ID NO: 300 - protein, 156 aa, Artificial sequence
  Synthetic
  MISC_FEATURE (1)..(1): Optional
  MISC_FEATURE (70)..(70): Xaa = Ala or Lys
MTKKVGIVDTTFARVDMASAAILTLKMESPNIKIIRKTVPGIKDLPVACKKLLEEEGCDIVMALGMPGKXEKDKVCAHEASLGLMLAQLMTNKHIIEVFVHEDEAKDDAELKILAARRAIEHALNVYYLLFKPEYLTRMAGKGLRQGFEDAGPARE

SEQ ID NO: 301 - protein, 209 aa, Artificial sequence
  Synthetic
  MISC_FEATURE (1)..(1): Optional
  MISC_FEATURE (2)..(2): Xaa - Ser or Asp
  MISC_FEATURE (3)..(3): Xaa - Thr or Asp
  MISC_FEATURE (10)..(10): Xaa = Ala or Arg
  MISC_FEATURE (85)..(85): Xaa = Thr or Asp
  MISC_FEATURE (119)..(119): Xaa - Ala or Gln
  MISC_FEATURE (163)..(163): Xaa = Ser or Asp
  MISC_FEATURE (189)..(189): Xaa = Thr or Arg
MXXINNQLKXLKVIPVIAIDNAEDIIPLGKVLAENGLPAAEITFRSSAAVKAIMLLRSAQPEMLIGAGTILNGVQALAAKEAGAXFVVSPGFNPNTVRACQIIGIDIVPGVNNPSTVEXALEMGLTTLKFFPAEASGGISMVKSLVGPYGDIRLMPTGGITPXNIDNYLAIPQVLACGGTWMVDKKLVXNGEWDEIARLTREIVEQVNP

SEQ ID NO: 302 - protein, 114 aa, Artificial sequence
  Synthetic
  MISC_FEATURE (1)..(1): Optional
  MISC_FEATURE (13)..(13): Xaa = Thr or Asp
  MISC_FEATURE (33)..(33): Xaa = Lys or Glu
  MISC_FEATURE (71)..(71): Xaa = Ser or Asp
  MISC_FEATURE (74)..(74): Xaa = Arg or Glu
  MISC_FEATURE (101)..(101): Xaa = Asn or Asp
  MISC_FEATURE (103)..(103): Xaa = Asn or Asp
MPIFTLNTNIKAXDVPSDFLSLTSRLVGLILSXPGSYVAVHINTDQQLSFGGSTNPAAFGTLMSIGGIEPXKNXDHSAVLFDHLNAMLGIPKNRMYIHFVXLXGDDVGWNGTTF

SEQ ID NO: 303 - protein, 157 aa, Artificial sequence
  Synthetic
  MISC_FEATURE (1)..(1): Optional
  MISC_FEATURE (9)..(9): Xaa = Tyr or His
  MISC_FEATURE (82)..(82): Xaa = Asn or Asp
  MISC_FEATURE (87)..(87): Xaa = Arg or Asp
  MISC_FEATURE (105)..(105): Xaa = Ser or Asp
  MISC_FEATURE (119)..(119): Xaa = Arg or Glu
  MISC_FEATURE (121)..(121): Xaa = Arg or Glu
  MISC_FEATURE (124)..(124): Xaa = Ala or Asp
  MISC_FEATURE (126)..(126): Xaa = His or Asp
  MISC_FEATURE (128)..(128): Xaa = Arg or Glu
  MISC_FEATURE (150)..(150): Xaa = Ala or Asn
MNQHSHKDXETVRIAVVRARWHADIVDACVEAFEIAMAAIGGDRFAVDVFDVPGAYEIPLHARTLAETGRYGAVLGTAFVVXGGIYXHEFVASAVIDGMMNVQLXTGVPVLSAVLTPHXYXDSXEXHXFFAAHFAVKGVEAARACIEILXAREKIAA

SEQ ID NO: 304 - protein, 204 aa, Artificial sequence
  Synthetic
  MISC_FEATURE (1)..(1): Optional
  MISC_FEATURE (126)..(126): Xaa = Thr or Asp
  MISC_FEATURE (139)..(139): Xaa = Gln or Glu
  MISC_FEATURE (142)..(142): Xaa = Lys or Glu
  MISC_FEATURE (160)..(160): Xaa = Asn or Asp
  MISC_FEATURE (163)..(163): Xaa = Asn or Asp
  MISC_FEATURE (166)..(166): Xaa = Glu or Lys
  MISC_FEATURE (169)..(169): Xaa = Lys or Asp
  MISC_FEATURE (179)..(179): Xaa = Ser or Lys or Asp
  MISC_FEATURE (183)..(183): Xaa = Lys or Glu
  MISC_FEATURE (185)..(185): Xaa = Thr or Asp or Lys
  MISC_FEATURE (192)..(192): Xaa = Lys or Asp
  MISC_FEATURE (195)..(195): Xaa = Ala or Glu or Lys
  MISC_FEATURE (198)..(198): Xaa = Glu or Lys
  MISC_FEATURE (199)..(199): Xaa = Lys or Glu
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHXILKLFPGEVVGPXFVXAMKGPFPNVKFVPTGGVXLDXVCXWFXAGVLAVGVGXALVXGXPDEVREXAKXFVXIRGCTE

SEQ ID NO: 305 - protein, 157 aa, Artificial sequence
  Synthetic
  MISC_FEATURE (1)..(1): Optional
  MISC_FEATURE (9)..(9): Xaa = Tyr or His
  MISC_FEATURE (38)..(38): Xaa = Ala or Arg
  MISC_FEATURE (82)..(82): Xaa = Asn or Asp
  MISC_FEATURE (87)..(87): Xaa = Arg or Asp
  MISC_FEATURE (97)..(97): Xaa = Asp or Asn
  MISC_FEATURE (105)..(105): Xaa = Ser or Asp or Asn
  MISC_FEATURE (119)..(119): Xaa = Arg or Glu or Asn
  MISC_FEATURE (121)..(121): Xaa = Arg or Asp or Glu
  MISC_FEATURE (122)..(122): Xaa = Asp or Lys
  MISC_FEATURE (124)..(124): Xaa = Asp or Lys
  MISC_FEATURE (126)..(126): Xaa = His or Asp
MNQHSHKDXETVRIAVVRARWHAEIVDACVSAFEAAMXDIGGDRFAVDVFDVPGAYEIPLHARTLAETGRYGAVLGTAFVVXGGIYXHEFVASAVIXGMMNVQLXTGVPVLSAVLTPHXYXXSXAXTLLFLALFAVKGMEAARACVEILAAREKIAA

SEQ ID NO: 306 - protein, 159 aa, Artificial sequence
  Synthetic
  MISC_FEATURE (1)..(1): Optional
MGEVPIGDPKELNGMEIAAVYLQPIEMEPRGIDLAASLADIHLEADIHALKNNPNGFPEGFWMPYLTIAYALANADTGAIKTGTLMPMVADDGPHYGANIAMEKDKKGGFGVGTYALTFLISNPEKQGFGRHVDEETGVGKWFEPFVVTYFFKYTGTPK

SEQ ID NO: 307 - protein, 184 aa, Artificial sequence
  Synthetic
  MISC_FEATURE (1)..(1): Optional
MSQAIGILELTSIAKGMELGDAMLKSANVDLLVSKTISPGKFLLMLGGDIGAIQQAIETGTSQAGEMLVDSLVLANIHPSVLPAISGLNSVDKRQAVGIVETWSVAACISAADLAVKGSNVTLVRVHMAFGIGGKCYMVVAGDVLDVAAAVATASLAAGAKGLLVYASIIPRPHEAMWRQMVEG

SEQ ID NO: 308 - protein, 103 aa, Artificial sequence
  Synthetic
  MISC_FEATURE (1)..(1): Optional
MEEVVLITVPSALVAVKIAHALVEERLAACVNIVPGLTSIYRWQGSVVSDHELLLLVKTTTHAFPKLKERVKALHPYTVPEIVALPIAEGNREYLDWLRENTG

SEQ ID NO: 309 - protein, 122 aa, Artificial sequence
  Synthetic
  MISC_FEATURE (1)..(1): Optional
MVRGIRGAITVEEDTPAAILAATIELLLKMLEANGIQSYEELAAVIFTVTEDLTSAFPAEAARLIGMHRVPLLSAREVPVPGSLPRVIRVLALWNTDTPQDRVRHVYLNEAVRLRPDLESAQ

SEQ ID NO: 310 - protein, 177 aa, Artificial sequence
  Synthetic
  MISC_FEATURE (1)..(1): Optional
MSKAKIGIVTVSDRASAGITADISGKAIILALNLYLTSEWEPIYQVIPDEQDVIETTLIKMADEQDCCLIVTTGGTGPAKRDVTPEATEAVCDRMMPGFGELMRAESLKEVPTAILSRQTAGLRGDSLIVNLPGDPASISDCLLAVFPAIPYCIDLMEGPYLECNEAMIKPFRPKAK

SEQ ID NO: 311 - protein, 122 aa, Artificial sequence
  Synthetic
  MISC_FEATURE (1)..(1): Optional
MVRGIRGAITVNSDTPTSIIIATILLLEKMLEANGIQSYEELAAVIFTVTEDLTSAFPAEAARQIGMHRVPLLSAREVPVPGSLPRVIRVLALWNTDTPQDRVRHVYLSEAVRLRPDLESAQ

SEQ ID NO: 312 - protein, 172 aa, Artificial sequence
  Synthetic
  MISC_FEATURE (1)..(1): Optional
MRITTKVGDKGSTRLFGGEEVWKDSPIIEANGTLDELTSFIGEAKHYVDEEMKGILEEIQNDIYKIMGEIGSKGKIEGISEERIAWLLKLILRYMEMVNLKSFVLPGGTLESAKLDVCRTIARRALRKVLTVTREFGIGAEAAAYLLALSDLLFLLARVIEIEKNKLKEVRS

SEQ ID NO: 313 - protein, 123 aa, Artificial sequence
  Synthetic
  MISC_FEATURE (1)..(1): Optional
MPHLVIEATANLRLETSPGELLEQANKALFASGQFGEADIKSRFVTLEAYRQGTAAVERAYLHACLSILDGRDIATRTLLGASLCAVLAEAVAGGGEEGVQVSVEVREMERLSYAKRVVARQR

SEQ ID NO: 314 - protein, 158 aa, Artificial sequence
  Synthetic
  MISC_FEATURE (1)..(1): Optional
MESVNTSFLSPSLVTIRDFDNGQFAVLRIGRTGFPADKGDIDLCLDKMIGVRAAQIFLGDDTEDGFKGPHIRIRCVDIDDKHTYNAMVYVDLIVGTGASEVERETAEEEAKLALRVALQVDIADEHSCVTQFEMKLREELLSSDSFHPDKDEYYKDFL

SEQ ID NO: 315 - protein, 113 aa, Artificial sequence
  Synthetic
  MISC_FEATURE (1)..(1): Optional
MPVIQTFVSTPLDHHKRLLLAIIYRIVTRVVLGKPEDLVMMTFHDSTPMHFFGSTDPVACVRVEALGGYGPSEPEKVTSIVTAAITAVCGIVADRIFVLYFSPLHCGWNGTNF

SEQ ID NO: 316 - protein, 103 aa, Artificial sequence
  Synthetic
  MISC_FEATURE (1)..(1): Optional
MEEVVLITVPSALVAVKIAHALVEERLAACVNIVPGLTSIYREEGSVVSDHELLLLVKTTTDAFPKLKERVKELHPYEVPEIVALPIAEGNREYLDWLRENTG

SEQ ID NO: 317 - protein, 119 aa, Artificial sequence
  Synthetic
NLAEKMYKAGNAMYRKGQYTIAIIAYTLALLKDPNNAEAWYNLGNAAYKKGEYDEAIEAYQKALELDPNNAEAWYNLGNAYYKQGDYDEAIEYYKKALRLDPRNVDAIENLIEAEEKQG

SEQ ID NO: 318 - protein, 119 aa, Artificial sequence
  Synthetic
EEAELAYLLGELAYKLGEYRIAIRAYRIALKRDPNNAEAWYNLGNAYYKQGDYREAIRYYLRALKLDPENAEAWYNLGNALYKQGKYDLAIIAYQAALEEDPNNAEAKQNLGNAKQKQG

SEQ ID NO: 319 - protein, 119 aa, Artificial sequence
  Synthetic
NSAEAMYKMGNAAYKQGDYILAIIAYLLALEKDPNNAEAWYNLGNAAYKQGDYDEAIEYYQKALELDPNNAEAWYNLGNAYYKQGDYDEAIEYYEKALELDPNNAEALKNLLEAIAEQD

SEQ ID NO: 320 - protein, 187 aa, Artificial sequence
  Synthetic
TDPLAVILYIAILKAEKSIARAKAAEALGKIGDERAVEPLIKALKDEDALVRAAAADALGQIGDERAVEPLIKALKDEEGLVRASAAIALGQIGDERAVQPLIKALTDERDLVRVAAAVALGRIGDEKAVRPLIIVLKDEEGEVREAAAIALGSIGGERVRAAMEKLAERGTGFARKVAVNYLETHK

SEQ ID NO: 321 - protein, 119 aa, Artificial sequence
  Synthetic
EEAELAYLLGELAYKLGEYRIAIRAYRIALKRDPNNAEAWYNLGNAYYKQGDYDEAIEYYQKALELDPNNAEAWYNLGNAYYKQGDYDEAIEYYEKALELDPENLEALQNLLNAMDKQG

SEQ ID NO: 322 - protein, 279 aa, Artificial sequence
  Synthetic
IEEVVAEMIDILAESSKKSIEELARAADNKTTEKAVAEAIEEIARLATAAIQLIEALAKNLASEEFMARAISAIAELAKKAIEAIYRLADNHTTDTFMARAIAAIANLAVTAILAIAALASNHTTEEFMARAISAIAELAKKAIEAIYRLADNHTTDKFMAAAIEAIALLATLAILAIALLASNHTTEKFMARAIMAIAILAAKAIEAIYRLADNHTSPTYIEKAIEAIEKIARKAIKAIEMLAKNITTEEYKEKAKKIIDIIRKLAKMAIKKLEDNRT

SEQ ID NO: 323 - protein, 153 aa, Artificial sequence
  Synthetic
KYDGSKLRIGILHARWNAEIILALVLGALKRLQEFGVKRENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFN

SEQ ID NO: 324 - protein, 119 aa, Artificial sequence; identical to SEQ ID NO: 89
  Synthetic

SEQ ID NO: 325 - protein, 228 aa, Artificial Sequence
  Synthetic
MDSKGSSQKGSRLLLLLVVSNLLLPQGVLADTLCIGYHANNSTDTVDTVLEKNVTVTHSVNLGSGLRLATGLRNVPSIQSRGLFGAIAGFIEGGWTGMVDGWYGYHHQNEQGSGYAADLKSTQNAIDKITNMVNSVIEKMGSGGSGTYNAELLVLLLNERTLDYHDSNVKNLYEKVRNQLKNNAKEIGNGCFEFYHKCDNTCMESVKNGTYDYPKYSEEAKLNREKID

SEQ ID NO: 326 - protein, 228 aa, Artificial Sequence; identical to SEQ ID NO: 325
  Synthetic

SEQ ID NO: 327 - protein, 228 aa, Artificial Sequence
  Synthetic
MDSKGSSQKGSRLLLLLVVSNLLLPQGVLADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 328 - protein, 228 aa, Artificial Sequence
  Synthetic
MDSKGSSQKGSRLLLLLVVSNLLLPQGVLADTICIGYHANNSTDTVDTVLEKNVTVTHSVNLGSGLRMVTGLRNIPSIQSRGLFGAIAGFIEGGWTGMIDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKID

SEQ ID NO: 329 - protein, 228 aa, Artificial Sequence
  Synthetic
MDSKGSSQKGSRLLLLLVVSNLLLPQGVLADTICIGYHANNSTDTVDTVLEKNVTVTHSVNLGSGLRMATGLRNIPSIQSRGLFGAIAGFIEGGWTGMIDGWYGYHHQNEQGSGYAADQKSTQNAIDGITNMVNSVIEKMGSGGSGTYNAELLVLLLNERTLDFHDSNVRNLYEKVKSQLKNNAKEIGNGCFEFYHKCDDACMESVRNGTYDYPKYSEESKLNREEID

SEQ ID NO: 330 - protein, 228 aa, Artificial Sequence
  Synthetic
MDSKGSSQKGSRLLLLLVVSNLLLPQGVLADQICIGYHANNSTEKVDTILERNVTVTHAKDIGSGLVLATGLRNVPQIESRGLFGAIAGFIEGGWQGMVDGWYGYHHSNDQGSGYAADKESTQKAFDGITNMVNSVIEKMGSGGSGTYNAELLVLMLNERTLDFHDSNVKNLYDKVRMQLRDNVKELGNGCFEFYHKCDDECMNSVKNGTYDYPKYEEESKLNRNEIK

SEQ ID NO: 331 - protein, 232 aa, Artificial Sequence
  Synthetic
MDSKGSSQKGSRLLLLLVVSNLLLPQGVLADKLCLGHHAVPNGTIVKTITNDRIEVTNATELVFPGCGVLKLATGMRNVPEKQTRGIFGAIAGFIENGWEGMVDGWYGFRHQNSEGRGQAADLKSTQAAIDQINGMVNRVIELMEQGGPDCYLAELLVALLNQHVIDLTDSEMNKLFEKTKKQLRENAEDMGNGCFKIYHKCDNACIGSIRNGTYDHNVYRDEALNNRFQIK

SEQ ID NO: 332 - protein, 228 aa, Artificial Sequence
  Synthetic
MDSKGSSQKGSRLLLLLVVSNLLLPQGVLADQICIGYHANNSTEQVDTIMEKNVTVTHAQDIGSGLVLATGLRNSPQRESRGLFGAIAGFIEGGWQGMVDGWYGYHHSNEQGSGYAADKESTQKAIDGVTNMVNSIIDKMGSGGSGTYNAELLVLMLNERTLDFHDSNVKNLYDKVRLQLRDNAKELGNGCFEFYHKCDNECMESIRNGTYNYPQYSEEARLKREEIS

SEQ ID NO: 333 - protein, 228 aa, Artificial Sequence
  Synthetic
MDSKGSSQKGSRLLLLLVVSNLLLPQGVLADKICIGYHANNSTTQVDTLLEKNVTVTHSVELGSGLRLATGLRNVPQIATRGIFGAIAGFIEGGWTGMIDGWYGYHHENSQGSGYAADRESTQKAIDGITNMVNSIINKMNTGGSGTYNAELLVLLLNERTLDLHDANVKNLYEKVKSQLRDNANDLGNGCFEFWHKCDNECMESVKNGTYDYPKYQKESKLNRQGIE

SEQ ID NO: 334 - protein, 233 aa, Artificial Sequence
  Synthetic
MDSKGSSQKGSRLLLLLVVSNLLLPQGVLADKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIELMEQGGPDCYLAELLVAMLNQHVIDLADSEMDKLYERVKRQLRENAEEDGTGCFEIFHKCDDDCMASIRNNTYDHSKYREEAMQNRIQID

SEQ ID NO: 335 - protein, 228 aa, Artificial Sequence
  Synthetic
MDSKGSSQKGSRLLLLLVVSNLLLPQGVLADKICIGHQSTNSTETVDTLTETNVPVTHAKELGSGLKLAIGLRNVPARSNRGLFGAIAGFIEGGWPGLVAGWYGFQHSNDQGVGMAADRDSTQKAVDKITSMVNNIVDKMNKGGSGAYNAELLVLLLNQKTLDEHDANVNNLYNKVKRALGSNAMEDGKGCFELYHKCDDQCMETIRNGTYDRRKYREESRLERQRIE

SEQ ID NO: 336 - protein, 234 aa, Artificial Sequence
  Synthetic
MDSKGSSQKGSRLLLLLVVSNLLLPQGVLALDKICLGHHAVANGTIVKTLTNEQEEVTNATELVFPGCGVLMLATGMRNVPELIQGRGLFGAIAGFLENGWEGMVDGWYGFRHQNAQGTGQAADYKSTQAAIDQITGMVNRVVELMEQGGPDCYLAELLVAMLNQHVIDMADSEMRNLYERVRKQLRQNAEEDGKGCFEIYHACDDSCMESIRNNTYDHSQYREEALLNRLNIN

SEQ ID NO: 337 - protein, 5 aa, Artificial Sequence
  Synthetic
GSGSG

SEQ ID NO: 338 - protein, 4 aa, Artificial Sequence
  Synthetic
GPPG

SEQ ID NO: 339 - protein, 8 aa, Artificial Sequence
  Synthetic
GGSGGSGS

SEQ ID NO: 340 - protein, 641 aa, Artificial Sequence
  A/Brisbane/02/2018 HA 1-676 Y98F no lkr dn5B SA
MKAILVVLLYTFTTANADTLCIGYHANNSTDTVDTVLEKNVTVTHSVNLLEDKHNGKLCKLGGVAPLHLGKCNIAGWILGNPECESLSTARSWSYIVETSNSDNGTCFPGDFINYEELREQLSSVSSFERFEIFPKTSSWPNHDSNKGVTAACPHAGAKSFYKNLIWLVKKGNSYPKLNQTYINDKGKEVLVLWGIHHPPTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTAEGAINTSLPFQNVHPVTIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 341 - protein, 641 aa, Artificial Sequence
  A/Idaho/07/2018 HA 1-676 Y98F no lkr dn5B SA
MKAILVVLLYTFTTANADTLCIGYHANNSTDTVDTVLEKNVTVTHSVNLLEDKHNGKLCKLRGVAPLHLGKCNIAGWILGNPECESLSTARSWSYIVETSNSDNGTCFPGDFINYEELREQLSSVSSFERFEIFPKTSSWPNHDSNKGVTAACPHAGAKSFYKNLIWLVKKGNSYPKLNQTYINDKGKEVLVLWGIHHPPTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 342 - protein, 641 aa, Artificial Sequence
  A/Switzerland/3330/2017 HA 1-676 Y98F no lkr dn5B SA
MKAILVVLLYTFTTANADTLCIGYHANNSTDTVDTVLEKNVTVTHSVNLLEDKHNGKLCKLRGVAPLHLGKCNIAGWILGNPECESLSTARSWSYIVETSNSDNGTCFPGDFINYEELREQLSSVSSFERFEIFPKTSSWPNHDSNKGVTAACPHAGAKSFYKNLIWLVKKGNSYPKLNQTYINDKGKEVLVLWGIHHPPTTADQQSLYQNADAYVFVGTSRYSKKFKPEIATRPKVRDQEGRMNYYWTLVDPGDKITFEATGNLVVPRYAFTMERDAGSGIIISDTPVHDCNTTCQTPEGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 343 - protein, 644 aa, Artificial Sequence
  A/Perth/1008/2019 HA 1-676 Y98F GG dn5B SA
MKTIIALSYILCLVFAQKIPGNDNSTATLCLGHHAVPNGTIVKTITNDRIEVTNATELVQNSSIGEICDSPHQILDGGNCTLIDALLGDPQCDGFQNKKWDLFVERSRAYSNCFPYDVPDYASLRSLVASSGTLEFKNESFNWAGVKQNGTSSACIRGSSSSFFSRLNWLTHLNYTYPALNVTMPNKEQFDKLYIWGVHHPGTDKDQIFLYARSSGRITVSTRRSQQAVIPNIGFRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVGGSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 344 - protein, 644 aa, Artificial Sequence
  A/Wisconsin/549/2019 HA 1-676 Y98F GG dn5B SA
MKTIIALSCILCLVFAQKIPGNDNSTATLCLGHHAVPNGTIVKTITNDRIEVTNATELVQNSSIGEICDSPHQILDGENCTLIDALLGDPQCDGFQNKKWDLFVERNKAYSNCFPYDVPDYASLRSLVASSGTLEFNNESFNWAGVTQNGKSSSCIRGSKSSFFSRLNWLTHLNSKYPALNVTMPNNEQFDKLYIWGVHHPGTDKDQISLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGLVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDVGNGCFKIYHKCDNACMGSIRNGTYDHNVYRDEALNNRFQIKGVGGSAEEAELAYLLGELAYKLGEYRIAIRAYRIALKRDPNNAEAWYNLGNAYYKQGRYREAIEYYQKALELDPNNAEAWYNLGNAYYERGEYEEAIEYYRKALRLDPNNADAMQNLLNAKMREE

SEQ ID NO: 345 - protein, 656 aa, Artificial Sequence; identical to SEQ ID NO: 153
  B/Colorado/06/2017 HA 1-674 no lkr dn5B SA

SEQ ID NO: 346 - protein, 657 aa, Artificial Sequence; identical to SEQ ID NO: 133
  B/Phuket/3073/2013 HA 1-674 no lkr dn5B SA

SEQ ID NO: 347 - protein, 171 aa, Artificial Sequence
  I53-dn5 mIgK-mod A 2
METDTLLLWVLLLWVPGSTGDKYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

SEQ ID NO: 348 - protein, 183 aa, Artificial Sequence
  I53-dn5 Prolactin A_LF4_W16E
MDSKGSSQKGSRLLLLLVVSNLLLPQGVLAKYDGSKLRIGILHARENAEIILALVLGALKRLQEFGVKRENIIIETVPGSFELPYGSKLFVEKQKRLGKPLDAIIPIGVLIRGSTPHFDYIADSTTHQLMKLNFELGIPVIFGVITADTDEQAEARAGLIEGKMHNHGEDWGAAAVEMATKFN

SEQ ID NO: 349 - protein, 180 aa, Artificial Sequence
  I53-dn5 Prolactin A
MDSKGSSQKGSRLLLLLVVSNLLLPQGVLAKYDGSKLRIGILHARGNAEIILELVLGALKRLQEFGVKRENIIIETVPGSFELPYGSKLFVEKQKRLGKPLDAIIPIGVLIRGSTAHFDYIADSTTHQLMKLNFELGIPVIFGVLTTESDEQAEERAGTKAGNHGEDWGAAAVEMATKFN

What is claimed is:

1. A nanoparticle, comprising:
   (a) a plurality of first assemblies, each first assembly comprising a plurality of identical first proteins; and,
   (b) a plurality of second assemblies, each second assembly comprising a plurality of second proteins;
      wherein at least one second assembly comprises at least one second protein joined to an immunogenic portion of an influenza hemagglutinin (HA) protein, thereby forming a fusion protein;
      wherein the sequence of the first protein differs from the sequence of the second protein;
      wherein the plurality of first assemblies non-covalently interact with the plurality of second assemblies to form the nanoparticle; and,
   wherein the nanoparticle displays the immunogenic portion of an HA protein on its surface.

2. The nanoparticle of claim 1, wherein each of the first proteins comprises an amino acid sequence at least 80%, 85%, 90%; 91%, 95%, 96%, 97%, 98%, or 99% identical, or 100% identical to a sequence selected from the group consisting of: SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:32, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:227, SEQ ID NO:229 SEQ ID NO:231 SEQ ID NO:233, SEQ ID NO:235, SEQ ID NO:237, SEQ ID NO:239, SEQ ID NO:241 SEQ ID NO:243, SEQ ID NO:267, SEQ ID NO:268, SEQ ID NO: 271, SEQ ID NO:273, SEQ ID NO:275, SEQ ID NO:282, SEQ ID NO:285, SEQ ID NO:287, SEQ ID NO:288, SEQ ID NO:291, SEQ ID NO:293, SEQ ID NO:295, SEQ ID NO:297, SEQ ID NO:299, SEQ ID NO:347, SEQ ID NO:348, and SEQ ID NO:349, and wherein a plurality of first proteins interact to form the first assemblies.

3. The nanoparticle of claim 1, wherein each of the second protein comprises an amino acid sequence at least 80%, 85%, 90%, 91%, 95%, 96%, 97%, 98%, or 99% identical, or 100% identical to a sequence selected from the group consisting of SEQ ID NO:89, SEQ ID NO:245, SEQ ID NO:247, SEQ ID NO:249, SEQ ID NO:251, SEQ ID NO:253, SEQ ID NO:255, SEQ ID NO:257, SEQ ID NO:266, SEQ ID NO:269, SEQ ID NO:270, SEQ ID NO:272, SEQ ID NO:274, SEQ ID NO:283, SEQ ID NO:284, SEQ ID NO:286, SEQ ID NO:289, SEQ ID NO:290, SEQ ID NO:292, SEQ ID NO:294, SEQ ID NO:296, SEQ ID NO:298, and wherein a plurality of proteins non-covalently interact to form the second assemblies.

4. The nanoparticle of claim 1, wherein the first protein and the second protein comprise amino acid sequences at least 80%, 85%, 90%, 91%, 95%, 96%, 97%, 98%, or 99% identical, or 100% identical, to the sequences of first and second proteins, respectively, selected from the pairs of first and second proteins in of SEQ ID NO:267 and SEQ ID NO:266; SEQ ID NO:268 and SEQ ID NO:269; SEQ ID NO:268 and SEQ ID NO:289; SEQ ID NO:288 and SEQ ID NO:269; SEQ ID NO:271 and SEQ ID NO:270; SEQ ID NO:291 and SEQ ID NO:270; SEQ ID NO:293 and SEQ ID NO:270; SEQ ID NO:271 and SEQ ID NO:290; SEQ ID NO:291 and SEQ ID NO:290; SEQ ID NO:293 and SEQ ID NO:290; SEQ ID NO:271 and SEQ ID NO:292; SEQ ID NO:291 and SEQ ID NO:292; SEQ ID NO:293 and SEQ ID NO:292; SEQ ID NO:273 and SEQ ID NO:272; SEQ ID NO:295 and SEQ ID NO:272; SEQ ID NO:297 and SEQ ID NO:272; SEQ ID NO:299 and SEQ ID NO:272; SEQ ID NO:273 and SEQ ID NO:294; SEQ ID NO:295 and SEQ ID NO:294; SEQ ID NO:297 and SEQ ID NO:294; SEQ ID NO:299 and SEQ ID NO:294; SEQ ID NO:273 and SEQ ID NO:296; SEQ ID NO:295 and SEQ ID NO:296; SEQ ID NO:297 and SEQ ID NO:296; SEQ ID NO:299 and SEQ ID NO:296; SEQ ID NO:273 and SEQ ID NO:298; SEQ ID NO:295 and SEQ ID NO:298; SEQ ID NO:297 and SEQ ID NO:298; SEQ ID NO:299 and SEQ ID NO:298; SEQ ID NO:275 and SEQ ID NO:274; SEQ ID NO:282 and SEQ ID NO:283; SEQ ID NO:285 and SEQ ID NO:284; SEQ ID NO:287 and SEQ ID NO:286; SEQ ID NO:288 and SEQ ID NO:289; SEQ ID NO:300 and SEQ ID NO:301; SEQ ID NO:303 and SEQ ID NO:302; SEQ ID NO:305 and SEQ ID NO:304; SEQ ID NO:306 and SEQ ID NO:307; SEQ ID NO:308 and SEQ ID NO:309; SEQ ID NO:310 and SEQ ID NO:311; SEQ ID NO:312 and SEQ ID NO:313; SEQ ID NO:314 and SEQ ID NO:315; SEQ ID NO:316 and SEQ ID NO:309; SEQ ID NO:317 and SEQ ID NO:318; SEQ ID NO:319 and SEQ ID NO:320; SEQ ID NO:321 and SEQ ID NO:322; SEQ ID NO:321 and SEQ ID NO:322; SEQ ID NO:307 and SEQ ID NO:306; SEQ ID NO:309 and SEQ ID NO:308; SEQ ID NO:311 and SEQ ID NO:310; SEQ ID NO:313 and SEQ ID NO:312; SEQ ID NO:315 and SEQ ID NO:314; SEQ ID NO:309 and SEQ ID NO:316; SEQ ID NO:318 and SEQ ID NO:317; SEQ ID NO:320 and SEQ ID NO:319; SEQ ID NO:322 and SEQ ID NO:321; or SEQ ID NO:89 and one of SEQ ID NO:41, 43, 45, 47, 49, 51, 53, 55, 57, 59, 61, 63, 65, 67, 69, 71, 73, 75, 77, 79, 81, 83, 85, 87, 347, 348, and 349.

5. The nanoparticle of claim 1, wherein the second protein is joined to the immunogenic portion of an influenza HA protein by a linker.

6. The nanoparticle of claim 1, wherein the immunogenic portion of the HA protein is derived from an HA protein from a Type A, Type B, or Type C influenza vims.

7. The nanoparticle of claim 1, wherein the immunogenic portion of the HA protein is derived from an HA protein from an H1, H2, H3, H4, H5, H6, H7, H8, H9, H10, H11, H12, H13, H14, H15, H16, H17, or H18 influenza virus.

8. The nanoparticle of claim 1, wherein the immunogenic portion of the HA protein comprises at least 6, 8, 10, 25, 50, 75, 100, 150, 200, 250, 300, 350, 400, 450, or 500, or more contiguous amino acid residues from a sequence at least 80%, 85%, 90%, 91%, 95%, 96%, 97%, 98%, or 99% identical, or 100% identical to an amino acid sequence selected from the group consisting of SEQ ID NOs: 1, 4, 7, 10, 13, 16, 19, 22, 25, 28, 31, 34, and 37.

9. The nanoparticle of claim 1, wherein the immunogenic portion is from the head region of an influenza virus HA protein.

10. The nanoparticle of claim 1, wherein the immunogenic portion comprises
   (a) at least 6, 8, 10, 25, 50, 75, 100, or 200, or more contiguous amino acid residues from an amino acid sequence that corresponds to amino acid residues 59-291 of SEQ ID NO:1; or
   (b) at least 6, 8, 10, 25, 50, 75, 100, or 200, or more contiguous amino acid residues from an amino acid sequence at least 80%, 85%, 90%, 91%, 95%, 96%, 97%, 98%, or 99% identical, or 100% identical to an amino acid sequence selected from the group consisting of SEQ ID NOs:2, 5, 8, 11, 14, 17, 20, 23, 26, 29, 32, 35, and 38.

11. The nanoparticle of claim 1, wherein the immunogenic portion is from the stem region of an influenza virus HA protein.

12. The nanoparticle of claim 11, wherein the immunogenic portion of an HA protein comprises
   (a) at least 6, 8, 10, 25, or 50, or more contiguous amino acid residues, from a sequence that is at least 80%, 85%, 90%, 91%, 95%, 96%, 97%, 98%, or 99% identical, or 100% identical to amino acid residues 1-58 of SEQ ID NO: 1, amino acid residues 1-58 of SEQ ID NO:4, amino acid residues 1-67 of SEQ ID NO:7, amino acid residues 1-68 of SEQ ID NO:10, amino acid residues 1-68 of SEQ ID NO:13, amino acid residues 1-5 of SEQ ID NO:16, amino acid residues 1-57 of SEQ ID NO:19, amino acid residues 1-57 of SEQ ID NO:22, amino acid residues 1-59 of SEQ ID NO:25, amino acid residues 1-59 of SEQ ID NO:28, amino acid residues 1-58 of SEQ ID NO:31, amino acid residues 1-67 of SEQ ID NO:34, or amino acid residues 1-68 of SEQ ID NO:37; or
   (b) at least 6, 8, 10, 25, 50, 75, 100, or 200, or more contiguous amino acid residues, from a sequence at least 80%, 85%, 90%, 91%, 95%, 96%, 97%, 98%, or 99% identical, or 100% identical to amino acid residues 292-517 of SEQ ID NO:1, amino acid residues 293-515 of SEQ ID NO:4, amino acid residues 294-517 of SEQ ID NO:7, amino acid residues 311-539 of SEQ ID NO:10, amino acid residues 310-538 of SEQ ID NO:13, amino acid residues 289-518 of SEQ ID NO:16, amino acid residues 291-520 of SEQ ID NO:19, amino acid residues 294-523 of SEQ ID NO:22, amino acid residues 287-516 of SEQ ID NO:25, amino acid residues 287-516 of SEQ ID NO:28, amino acid residues 288-518 of SEQ ID NO:31, amino acid residues 294-525 of SEQ ID NO:34, or amino acid residues 308-537 of SEQ ID NO:3.

13. The nanoparticle gf claim 1, wherein the immunogenic portion comprises an influenza virus stabilized HA stem protein.

14. A nanoparticle, comprising:
   (a) a plurality of first assemblies, each first assembly comprising a plurality of identical first proteins; and,
   (b) a plurality of second assemblies, each second assembly comprising a plurality of second proteins;
   wherein at least one second assembly comprises at least one second protein joined to an immunogenic portion of an influenza hemagglutinin (HA) protein, thereby forming a fusion protein;
   wherein the sequence of the first protein differs from the sequence of the second protein;
   wherein the plurality of first assemblies non-covalently interact with the plurality of second assemblies to form the nanoparticle; and,
   wherein the nanoparticle displays the immunogenic portion of an HA protein on its surface; wherein the immunogenic portion comprises an influenza virus stabilized HA stem protein; and
   wherein the stabilized stem protein comprises an amino acid sequence at least 80%, 85%, 90%, 91%, 95%, 96%, 97%, 98%, 99%, or 100% identical, to an amino acid sequence corresponding to amino acids 1-58 of SEQ ID NO: 1, covalently joined, either directly or through a peptide linker, to an amino acid sequence at least 80%, 85%, 90%, 91%, 95%, 96%, 97%, 98%, or 99% identical, or 100% identical, to an amino acid sequence corresponding to amino acids 292-517 of SEQ ID NO:1, such that the stabilized stem protein lacks the amino acid sequence corresponding to amino acids 59-291 (SEQ ID NO:2).

15. The nanoparticle of claim 1, wherein the immunogenic portion comprises any influenza virus HA protein comprising the amino acid sequence of or encoded by a nucleic acid of any one of SEQ ID NO:1-39 and 323-334.

16. The nanoparticle of claim 1, wherein the immunogenic portion comprises an amino acid sequence at least 80%, 85%, 90%, 91%, 95%, 96%, 97%, 98%, 99%, or 100% identical to a sequence selected from the group consisting of SEQ ID NO:1, SEQ ID NO:4, SEQ ID NO:7, SEQ ID NO: 10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, SEQ ID NO:37, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, and SEQ ID NO:336.

17. The nanoparticle of claim 1, wherein the fusion protein comprises an amino acid sequence at least 80%, 85%, 90%, 91%, 95%, 96%, 97%, 98%, 99%, or 100% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO: 109, SEQ ID NO:111, SEQ ID NO:113, SEQ ID NO:115, SEQ ID NO:117, SEQ ID NO:119, SEQ ID NO:12L SEQ ID NO:123, SEQ ID NO:125, SEQ ID NO:127, SEQ ID NO:129, SEQ ID NO:13L SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:259, SEQ ID NO:261, SEQ ID NO:263, and SEQ ID NO:265, wherein the fusion protein non-covalently interacts to form the second assembly.

18. The nanoparticle of claim 1, wherein the nanoparticle comprises at least two species of fusion protein.

19. The nanoparticle of claim 18, wherein the nanoparticle displays an immunogenic portion of 2 or more different immunogenic regions of HA proteins selected from the group consisting of ectodomain, stem, stabilized stem, and head regions.

20. The nanoparticle of claim 18, wherein the immunogenic portion of the different HA proteins are selected from the group consisting of immunogenic portions of an H1, H2, H3, H4, H5, H6, H7, H8, H9, H10, H11, H12, H13, H14, H15, H16, H17, and H18 HA protein.

21. A fusion protein comprising
(a) an amino acid sequence at least 80%, 85%, 90%, 91%, 95%, 96%, 97%, 98%, 99%, or 100% identical to a sequence selected from the group consisting of SEQ ID NO:89, SEQ ID NO:245, SEQ ID NO:247, SEQ ID NO:249, SEQ ID NO:251, SEQ ID NO:253, SEQ ID NO:255, and SEQ ID NO:257, joined to an immunogenic portion of an influenza virus HA protein; or
(b) an amino acid sequence at least 80%, 85%, 90%, 91%, 95%, 96%, 97%, 98%, or 99% identical, or 100% identical to a sequence selected from the group consisting of SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111 SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201 SEQ ID NO:203, SEQ ID NO:205, SEQ ID NO:207, SEQ ID NO:209, SEQ ID NO:211 SEQ ID NO:213, SEQ ID NO:215, SEQ ID NO:217, SEQ ID NO:219, SEQ ID NO:221 SEQ ID NO:223, SEQ ID NO:225, SEQ ID NO:259, SEQ ID NO:261, SEQ ID NO:263, SEQ ID NO:265, and SEQ ID NOS:340-346.

22. A composition comprising the nanoparticle of claim 1.

23. A vaccine comprising the nanoparticle of claim 1.

24. A method of vaccinating a subject against influenza virus, the method comprising administering the nanoparticle claim 1 to the subject.

25. A method of detecting anti-influenza virus antibodies comprising:
a. contacting at least a portion of a sample being tested for the presence of anti-influenza antibodies with the nanoparticle of claim 1; and,
b. detecting the presence of an antibody-nanoparticle complex;
wherein the presence of an antibody-nanoparticle complex indicates that the sample contains anti-influenza antibodies.

26. A method of identifying a subject having anti-influenza virus antibodies, the method comprising:
a. contacting a sample from a subject being tested for anti-influenza antibodies with the nanoparticle of claim 1; and,
b. analyzing the contacted sample for the presence of an antibody-nanoparticle complex
wherein the presence of an antibody-nanoparticle complex indicates the subject has anti-influenza antibodies.

27. A method of identifying a subject that has been exposed to influenza virus, the method comprising:
a. contacting at least a portion of a sample from a subject with the nanoparticle of claim 1;
b. analyzing the contacted sample for the presence or level of an antibody/nanoparticle complex, wherein the presence or level of antibody-nanoparticle complex indicates the presence or level of recent anti-influenza antibodies; and
c. comparing the recent anti-influenza antibody level with a past anti-influenza antibody level;

wherein an increase in the recent anti-influenza antibody level over the past anti-influenza antibody level indicates the subject has been exposed to influenza virus subsequent to determination of the past anti-influenza antibody level.

28. A method for measuring the response of a subject to an influenza vaccine, the method comprising:
   a. administering to the subject a vaccine for influenza virus;
   b. contacting at least a portion of a sample from the subject with the nanoparticle of claim 1;
   c. analyzing the contacted sample for the presence or level of an antibody/nanoparticle complex, wherein the presence or level of antibody-nanoparticle complex indicates the presence or level of recent anti-influenza antibodies, wherein an increase in the level of antibody in the sample over the pre-vaccination level of antibody in the subject indicates the vaccine induced an immune response in the subject.

29. A method of producing the nanoparticle of claim 1, the method comprising:
   (a) producing a first, synthetic protein that self-assembles into a first multimeric assembly:
   (b) producing a second protein comprising a self-assembling protein that self-assembles into a second multimeric assembly; and
   (c) contacting the first assembly with the second assembly and incubating the mixture under conditions suitable for the formation of a nanoparticle.

30. A nanoparticle, comprising
   (a) a plurality of first assemblies, each first assembly comprising a plurality of identical first polypeptides comprising an amino acid sequence that is at least 80%, 85%, 90%, 91%, 95%, 96%, 97%, 98%, 99%, or 100% identical to the full length of the amino acid sequence of any one of SEQ ID NOS: 43, 45, 47, 49, 51, 53, 55, 57, 59, 61, 63, 65, 67, 69, 71, 73, 75, 77, 79, 81, 83, 85, and 87, wherein the polypeptide is not identical to the full length of the amino acid sequence of SEQ ID NO: 41, and,
   (b) a plurality of second assemblies, each second assembly comprising a plurality of second polypeptides;
   wherein the sequence of the first polypeptide differs from the sequence of the second polypeptide; and
   wherein the plurality of first assemblies non-covalently interact with the plurality of second assemblies to form the nanoparticle.

* * * * *